United States Patent 11,549,145 (METHODS AND COMPOSITIONS FOR INHIBITING AND TREATING NEUROLOGICAL CONDITIONS) - sequence listing, part 14

SEQ ID NO: 66 - DNA, 317427 bp, Homo sapiens
gttcctaaatctgtgctactcaatggagaatcttccaagtataaaggtcaagttcatctgccaaaaattttttaaaaacatgacacattttacattgcttcatatttggatttttacctcttgtccagcttttgtcccccttaggatttctatttgcctttcttgttcttgttgacaaaagaaaaattatatctttactttatcattaatttaatacattattaaaattctatcatattataattaatttgtcattattaagaaatccatattcttcatcaggccttctgccttgactctgatgactggttctcatttggattgactgtactctactatataactgctattctgggatatcattctgctgcactcttaaattagatccacagcttctcgactttcacactttcctctttcctagattacttctatatacatttttgcttaagtataatctccagtcattttttttctaagagcatgtgttggatttaaattttctgaatcattgcatacctaaaaatgtatttattttatgctcacccttgatagacatttttaggtttgaagcatttcttctcaaacattgaaaccttttttttttttgatttggtattgataaaaatctgacacgaagttgattctaattcctttataggaaacctatttttatttctcttgagaagttcttaggatcttctcattttccacgatgtcctggaagaggatttgtttatgtctttgtttagtaattttgcttagagctcaaagggccctttcaatctgaaaacatgtttgaatttggagaatttacaccaatcatttccattataatttctttccccttttctcgtctgctctccaaatgctttttaggttgatgttgtacctattcaattgatcttctatgtatctacatttttcaagtatttgccttaactttgtcaactgtttcttttagtgaatattaattttagcagtcatagttttatattctgtgaattctgtatatttctcttttgctcccttgtcattatagctggtcatgctttgtggatgtgataccttcttgaatgcaatattcacttgaatgcttctgaggctactcattagaatttttaaaaatctctcttttgttcctgaatcacctcttctttcttcaggtcagttgttagtccaaaagatgtcaatgatccctagttatcagtttacatttattaataaagaactaggttgcctaatacaagtagctggtgtgagttatagcactatgttttcttaaccactttttccccaggataacagggcatgatcactggcagacttcacccaaggcctcgggtgggagacaggcagcagggtgagcaggcagtacacttgcctattcctcaactccacaccaaaatggggagggctttcttggggggtcatcactacagatccatgaatttcttaagagactggctttctaattttagattagggaacaatagggaaggtgatgaaggtgaaggaggtgtttaactttctcagctgttccatccttcaaaaaatcatcttgttctctgcctccttcctctgcctgatttccaaaaaccacacaagtttgaagcctgtctgtggttccatggccaggaagggtggctcctccctctacttttcttgtatttgctctggattgtaatgtctgcttggtttatccactttccatcttccacaaatttctgaaaatctcttgtttcttgatatccttttctcctatttttagaactgccctttttacttatgctgatatttgggatgtagctgaggcaaaagtttgtggtcagtgtgccttgagtcactaatcctgatatagattttaacatttggaaggcatacatttaaaataaacaagtagcatctatacaaaatatcacaaggaattaatcactcttggaaactatctttactctgatactttctgagtcttcatagcctgtaaaccaaatttatcaacaaaccatttagaaaaacaaaggcaataaacgaaattcatttttgatctgtatgaggtcacctagctttatagattagaaaagactcaattcaatcagaaactctgtggggtcctagatattccccagattgaattcaattgggaattttgtcatgcagaattaacaatagtttgtccttcagcctccagctgcctggtgctgtttctggtcccctgccagtattttcctccagacagccttgagcaggctttgggaggaggaggggaaggaggaaggtatggaacacccctctagttaaataggaaattgggaaatcagcagatgttagaggatactaaagatcctcagaaaaggccgagtgcaggaatagctcacacctgtaatctcagcaccttgggaggccaagatgagaggatagcctgagcccaggagttgaagatcagcctgggcaaacatagggacatagggagacctcatcactatcaaaaagaaaaaaaaataataataataccagcatggtggggtcctagctacttgggggttgggggagtggcagggaggctgccgagacaggaggattgctcgggcctgggaggatgaggctgcagtaagccaagattgcaccactgcactccagctgggcaacagagagaccctgtctcaaaagaaacaaataagcaaaaaataaaaagatcttcagaatattcctggagctttctttccccatgtgatgtgaaaaatcaagaactctgatgaaaagaaaaggcattatctgaaacactccaagcccaaaacaaatgtgtgggattggttaagcccggagatctttaaaaattgacatcatttggccaggcatggtggctcacacctgtaatcccagcactttgggaggccaaggtgggcagatcacttggggtcaggagtttgagaccagccgggccaaaatacaacaaattagccaggtgtggtgatgggtgcctgtaatcccagctactcgggaggctgaggcaagagaatcacttgaacccaggaggcggaggctgcagtgagctgagatcgtgccactgcactgcagcctgggtgacagagtgagactctgtctcaataaataaataaataaataaataaatattaacattatccattcgacagatacttattgggcattttctttgtaccaaatactttgtacttgccagtgacataatggtaagtaaagcatggatactaattttcaaggaattcatagtctgatggttgtatacagataaacaaagaattatcatcaaatgtagaaagcataatgaaagccatctatacaggtttatgaatacacagagcaggagtacctattcagtggtgtgctggtaaatgtttaacaagtggctttgtcggggcatgccttgatttatagcatccatcaatgtctctggtgtaaatactcccactatggccaatttcagtctaccaacttgatgtcattgaatgtggagttgctaagagatgtgtggcacaccattatagagtagctctcccacatagatagagtagacttcaagagcacagaacataaaatgtagtaatgattagaaaatgatgaattgttagtattcattacctccgtttttaatatcatttaattgcaaatttatataattttaaatgattgtgtttacaagctagttcaaaaaattctttaacatttaacaattggctccatagaagatgactttaaccaatgaagtctactcttcattgtgggctagggcaacagactttctgcaccatacaaatgagggtgaactcctttgcatgagtagctatgtccattagcattgaaagaagacaagtaacagaagagaagagggagcaatgagaagagctgagatgctcagaacattgcaccgcatacaaccaaagcagaaaactttataaccctgcctttcaactattttctccatataataaccttccgcataaggggagaagaaagggagagatcagttagcccttaggtccctaaatagtaaggacaaaaaatcacatgaaaattacaatattcatttccatccccatggaacattccttccagtctatgctgatgtggactgccaaggagggcagacttgaagacttaacaaaatgatccactggaaatcctacgttagcagtggcgctcataacttcatacaggactgcaggctcagatttgcaggggtgttcacacagttctgtggaatgagagcaactcaggagtggactcagcaaatggttgagtcaactgtcatttttaaactatgtcttcaaaactctcaccaaaatgtatacacacaaatgcgttataacctgtatcaggcctcttttgattgcaaataacagaaagacctggctctaatgggcttaggtgttaaagacatttaatggctaacttaactgaagaagtctaagggagagctcagagctcccttaaggtagttcttgagcaggggctgaagtgatgacagtcagatatggtgtctctttcttttggatccactgccattttcagacaggctctgccctcaaagtcacaggaaggctatagcagtttcatagcccttatatctgctcagcttctcccttctagcagctgagtaaaattcctgggcttgtctctggctgaaacatatctagtagcatctctatgaagctgccagtacgttaggtccatggctcccaaactcagctaacacagtaaagtcacctggggaatgtgttaaaatgccaaagaacaggccacacttccaggcaattaaatcacaatctctggggttggatccaggcaacattattttcttaaggttacaaggtaattccaatggagagaaaaatttagaaacccctgaattgggtgctcataaaaataggagattttagactcatcttctgatttactaagaaagtcaagtttgattaatttccttaatgtccacctcaaagtctttcttcctatgctttcctgtctctgtgacaagagtgtccctcttgctcactctagctggctgccatctgtctcgtggtctcacactcacactgtcttgcctggttctagagttcatccctcttctagtttgcatcttgaaattttacctccctactggttctatccttttaaaaaatgctcagatttctcccatcctataatagccttccttatcccccatgaccccgccctccacccccacaggctgctgcccatctacagcctaactttcaccttcagacttcttaaaagagtggtctgcccttgttgcctttaatgcagagaatccttataatctggtttggacatcaataccctgtgaaaactgttctctcaaaggtcagcaatgacccacttacaaaacagaagggctgcttctcgcctctccttctctcatctttgctttggtttttagatattacggtatccaaacgctatttctcccactgtttttctctctgccacctctattagcttaagaaagccttggggaaaatgtgtgggacgtgtatcctaaacacatttctcagacaatatgtatcagaagacttgaaagtgaagatacatgaaggcaacaatttaaagcacaaaataaattctttaaagacaattcagtatcatgtattagactgaaaactgggaaacaaactaaagatatattatccacataaggaaatactacagagacagtaacagtttcctatgacaagtgtgtgctaatgtgcacaaatgggcagaatattaggaagaagatgtaagacaaaacatgtattatacatataatttcaacttattaaaaagcataataatttgtaaatcaatttgttttcctccattggtttccattattatgatgacaacatatctttagtgatatttagttttaccttttctcctaattcatctgttttgaaaatgaatagaaatttccttagtacaaatgtaacttattgtattcttcatatattcagctatttaataatgtagttggaattattagtaagaagctctttctcactttctaataccccgagctttgcctgaatttaggtggtcatcattgactgagacatccaagaccactgcttttattgctttttgtaatggcaaggtcaaagtttccttggtttgaagggtgcagtaacatcctttaaggagctacatgtaataaatatctgggtgcattttttttttggatatatgcgatactgaaacaaataattattttaaaaatctgcaaataagattttcttctgtatatttaataaagcagcagttactaattttaaatttaacataattctcatgtatatgggcaaaaaagtggtaagaaactaaaagagagaaaaagatgagtttcaaacactgacggcttgcctatccctagaaactatgtattttgcctcctctcaaatagtgggaagttatcaaattatatattttccgccagaataaagtgaatttactaatataagaatttcaaataaatcaactgtagtagaaaattaaatcattttgttatagctaacatgagtataaaacagttttcacaagtaatttttaatttacagattaagaaactgaaatttagtgggggaaattcagtttttttgtttgtttgtttttgccacacaagtaaaaataggaaagctaggaaaggttgacatatcttctaatttctaagtctattctatttcccctaccataaggaatgctgagagattagtgtggtgttgtcttgattaatttctctttattattctagataggcaggtctatggtttctatccgtttctagaagagaaaaaaaatggcaaaaatgaaacactggggttcctcctgtcctccacttgtgatcttaggaatgattcttaacttctctgaacctcttctttttcatctgtatggtggggataatgacgataatattgcaagatttaaatgagttagtacatgtaaaatgtttagaatagtacctggcagaaagtaagtgctcaataaatgttagctatccttatttccattcttcctcctaaacatttcccaaaagtatataagttaatcgattagaatgcctatcctacattggccctccttttcccagtaatgaaccagatatttcttcctaacctgctacaatcatataagaagggtgtagactccttcttgtttatatggggtcatacaaggcatagccaaaatttcctctggaggatgggtacctcctggaacgaggtaaagtatttctagcatccaattcccatttggaagacaggggagaaataaatgcgccattatgataattctaactagttatataaacgaaaagcttcagtccagtggagagtaaagcggtccaagccactgttcaatgtaaactccctcaaagcatgggctagaagcacagcaagaaatccatcacaatctggaccacgagcagcacttgcgcgagaacaagacctgcctgggacccagctgcagcattctcctgttcaagtggggtctctctatttgcaagagaaatatgccccatgccctagcaatagatgaaactccaataaaacaagacagacttactttgtgaaatatctattaagtgcatattattttaaaaagttgataggctagaaagataaatacgttaaatgcactagctttgatggcatgaaatgaaggggtggaggcaaagcagaaaggacatggttgcaggtgagatttggaaaggggtggaaagttaacgaggtggaggatacagttaagttgttccagatggcaggatctgacagagaaggccagcgagggttagcagaatggatgaggatggggagacaggagaaatgaggtccagcacagagagagagagcattctcaacccagatgatgatcagttctgaatcatatcacagagtggatgaggaatcattagagaagactgctgaaggaaccacaaggctagacacagacagatgggaaagagcaaagtgaccagaacagaaaatccaaggccaccagcaaaggagccatcaggtttggaacactgatactgaactctgtgatggattcagaattccttggattaaaagattctgcagatgagaaaagatgggaaatatttttcctcttccattaagacaaaacatttaaatgtgtttctttaattaagattacacttaggaaatgagtttctaaatagaagaacttttaaacacaggatgagtgtcagagtttaaagggatttagacgtcacctgagtaatccattaaaagtttatcagacaaactgtgagattgttcttgtcagagagaattgagaataagattactggttgtctgagatggttgagtttcagttctctctggaaacaagtcctagacgaatgtctgaccttccctttcaagcataatgattccatgattggggtaagtgtaaggaacaatgactgaaaaaatgagagtgagtgtgatcacaacccagccttttaatcttgctcagtgccagtggagagagcaatacccatacatgcccagacagcagaaaaggagaaaagatactgaggttgggaggagaaatcaggaagaagagagggagagagaaagaaagtagaatgcacagcagggagcagttccctgccagccacagatgtctcacttagacaccccattgggatgaaggtcaacggggctgcttatagtttgttagtgggaaagggacagggagagttaattctattttaggccatatgtgtatttgggaagagagagaaagtgaagataagtagaaaataaaatgacacgtaggccagctatgatgaaaaatgttgaagtctatactaaagtgaaggcaaaggtttccgacatgagctttgagccagtagagaaaagacagagagagagggtgggtggcagcaaaacaatgaaaggtgcccagagccgtgctccctgtggaatgtcagtaaatattaattggctgatgttggcattggtaggcagagtgaagcttgtgaaagaaaaatgccattgccagtggagcacgaaagttcagatctcggagctcaaaatggcagcacctgagcaagcagcagagtcacatcccatatcaccagagaaagtgattctctgcatatgaggccaaactgtctcaaggaaaagtaatcacacaatcatgacaagagaaaaagaacaaagtctgtgggagccatgaaaatatctccccttctctgagaacatactcccttcccctgaggtatggtagcccctagctgagaaaccagggctgtcccaggtaaacagctgtgaaggtaggtgccaagaagcctagatttacccactccagaaaacccttttgtcagatgtctctggaaacctcacaaaatgttattttgggatttggctctaaggttgggtaattggtagactctcattctggaggaagaaaagaacggcattgcttctttagatttcaatattagatgggaaacggaatgcttttgacggtgcttggtgttttcatgaaccaaagttcctctcataatggcaggcatgggccttttgggtaaaggttattttcttgctcttgttctacattggtaggtacctgataaggcaaaatgattgaaacagtggcttgaaacattaataagaaaatgactcaattcccaagtcagagaagtgctaagtttacctgaaatatattctactataatactgtggatcagtgtctatgtggagtgatccaaggacttgtctagaaatacatgttttatacatcttttaaaattacatctgacctaaagaaaaaatatttattgttcaataatatattcattttaaaaatgctttttacacctataaattgtcccagcccagaattctaagtgcaaaaatgtcagtgtctggcacatagtaggtacttaatcgatatttgttaagtatgtattagatatatgaagaatgtaagaatcaagtaaaaatatcaagaatgtgggtgtttgtagaaaattgtttcccttttattccatcattttctccttaagaaaattaagaagaaattgcaattgccatattgctttttcttgtgggtgatatcaaccacaaatagcaaggtagttttggagtcatgaagcaaacttccccctgctaagatctgggtaaggttttagccacaagaggcctaataaagctcttgaagcatttcctaagagctcacagaagatttaaatgccctactactttcaactagacaaatccaattcattttaacaaacagttttgaagtgcctactaagtgtaatgccttgtgctaaatgtctggaagagtgagtgttaggtggagccctcaatgggtataaagaaatatgtatgtttgggagttgagggtgagggtgtgggagttgtgtgagtagggagaatgggacaagaaagaaacttcaagtgtatatccacccctgtccccaaatacactcctgaccctaaaagaaaggtcattttaatattgtaattacatatgtttcctggttttatcattacagcttaagaaaacagcaccacaagtatgggtggggtgctagaactcaatgaatccactttggaacaagaagcatgggtggaacttgaacgttgttggacaagactgaagcagatggcaaggcaaggtaccgtgttactcaggtgcattcttgtaagtatttggacagccagttaaacacaaagaagaacccaattatggcaaattgattctgcaaagagattttattttaatcatcaactgacagtcttaagttaaataccaaatagagcagacataaagattttggaaaaaagtgtgaggtagcaactccaaagcagttatcaatactttcctcaattatctagatttttagcgactatcttagtaaacacttaaatctcctttcaatgcaggagatcaatgcttccataaaattcagaaaactgagaaagttaaaaatatttgtaagaactataaattgcttgggttcactctcttccttgtatgtagtacttataaaagaactgatacagatgaatagaaaatactgattgtttcatgtttatgatgtaagaagaccatcaacttctcaacatcaagataagtaaatgccaaaatcaggtcagaaaagaacttttcagaataagggcctgcctttaaaagtctcagccaaaaccgtaacagaaaggatagtctcttagtcatgatttataaacagaaattgtacgtctgtaccaattgtagaggataaagtcaaaacagaatttacagcctcctgctaatagcctaatttaaaatgtataatcttccctacatttcccccaaagtaccttttaaaggactcactctgctatccaaacaacttgcaaatgcattcggtaagttggtctacagtatttattctctttcctgttattgactcaagatctatttctcatgatttgctttgtgctcattcttctgccagataaaatattaattgcatttttagctgcactgctggtgatcaaagaattctgatatgtcaagctaaactgacagaaatagcatccattaacatatttataggttcagagcttctagaacataattatatccattaattactcaacagtactctatattacaggctgaaaaagaaaggcatttgcaactaaatacttttactcagaatgaagtttttttttaaataataaattttctctaaggaaggttctatctaaaggaaataaggcaagagagctcacatatctatatggacacaaggcaggatttttaaggcatccatttactaactttgcaatagaatgctcacaaagtaaacgagatggcacatccagaatggtttcaaataaaataataccttaaatattacagagaaatttaattactattttagagttctaagagtgacaatctgaagctggtaattcttgatgataagattccgagcaatgatttttactttcaaataaacttctagtattacataggaccaaagcatttggaattacatacttttctgaacatgcaattctaacacataaagaaattaaagctgtccagggaaaaagctcttaagatgttggaaagtcatagaacaaacaattattctgtggatccaccagctgtgcgagtcctgaatctgccagctgcatttagtatatgtatcatagaaaggacagtaacacacacttgactccttttggccagttaatcagcatgcaaaatgacggtttcccacaataacttcagcaccggacccaaacacattctcttttcagcaaagaatgaagtcattaaaaaaaaaatcacacaagctgctttcataatttcagcacgaacacaaccgagatgtaaggacagaaagcaaagccgagtctacctgtacatatgtatctatacatatttcactgagttctttgttgcctgacaataaattgcaaaggcagtcatatttgaaagtaaaaaccattaaactgtgtttataggatactgcaacagactcgctgagggaataacaaggaaagcacgatacctttagtaagtcgcctcagaatttgacaacggcatttaaaagagacagctatcattcttgctcactgctttctgtggcaaagtgtactcaaggctctctgctctggtggctgcagcagcagcagcatatgaattccttgcgcacataccaggagaaaggtagtcccagtggggagtgacaaagcttaattcctcttggctgatgcagaggtccgctacatgtcatctggcaaatctgtgtcattcactactactaccacccctgcctgccacagcctcctcccccttcacaatcacaatggcttagaaagtaatgccgtttcgatagcaacaaagcaccaaattgtacaaagcagggacgacactgtgtgaggagccattccataaatctaacgctaagcactgaacagtgcattctgtttaaggcaaaaggcgatgtatccagtcagttcagccaccatcagcccctttccttctcagcatcaagtcagtgtcctttatatgtctcatttaatgggaaatgcaagtgaaatgcttacactcttactttaggaagaaatgcatgggtcatgtactatgttctttaaacaacaaccaaaaaaaaaaaaaaaaaaaaggaaagaaaaagagggagggccgtttatatttgggattgaggaaagaatcacagttctgcctatagcggggaagcagctctaggacagagacctctttggtacttcctgaacctatgagagttaaggcagtgtctgtttatagagggaatacaagaaagggttagggctaggcagacaatcaggcagatggagtcccagcccctttaatcacccttccaaaaaaggacttggctggaaagcaacacagtcaagactgtttctaaagataccagaaataaaggcaaacaaggccaagtatttctatttttaatatactttattatactatttcccaaacaaccatcccccaaaccattcttctcattatgcaaataaaacggtcttgcgacatagcagatatttgtgagtatctgctccaatggagtgaagagcaaattaacaaacccttcacaatccattcacaaagtgataagaaggcggagcacacctcctcatctgccagcagcagcctgctcgccatatagtcaatacgaactaacatttggtagggaattttaatcaaaatccagaattctcccacaggagttaacataaacattcaggacaaaaaattagacagttggccaggaagtttaagaaaaaaaaaatcaattagtcaaaatgaaaagatatatcactgtctaaactacttgattaatatttctaggactttatgaattattcatacagttttattctctactcttcaggctgtgaaaaaactttcaagctggtttttaaaataacttccaacattccaaatttagtggtaaaactttcttttcttcattcataaattcaatatgaactcaaacaatttcaatccactgctattgaaatgcatatgctttgtattttgagtccaatagaaaaataatttgtgtgtgaaaaacatctgaatatcataagcatctactttaaaggtttttgaaaagaacagaattcttttaccaaggatggtctagctaaagcaaccactaatcaatagaaaatactatattaaatggactgcagtgcaaaatcaaatttttataattgttctgattagcataaatctttctttgaatttcaacccatattatgttcatctctattaggttatccctagaaatagtttagcctccttgatatttttttgctttaaatagaaatataccttagtactagagaactgagttactagctaaagtgagataaatacttacagttagctctttccaagattcttctccaaatctaacatatttcctaaaatccaggcactcagaatacgcagctgtcaattactattagtagaatcttgcctgtggaacaccaccaccccagcccagtctattcaaatacaactcaaaaccatacaggaatctcttgccttctgctattttgcagactcaaatccaatttgctttttccttatgactaaaatgatcaaatattttccccttttcctaatatgcttattttttttgttttgttttaaaagctctatcctctggtcccaagaaaggtcttcagaactactaaaatgtcctatttctttggcaggggaaataacccatcatggagctctttgaaaggtttctgagagcccaaactaggggattgttttttctctctttgaatactgtggctgccaatccatatctatcctattagtctgcccaggtgcagccccaggaatcttacagaaatggagcctcctggagtaattcttttccagaaaatgaacgaattcaccaggtattcccatcttcttccatttctggcctcgctaatgcttggagatttcctggggagccactcccaggtcaaccttcttgccctaaaccctttgtcctccctttgcctaatgcaagcttagcctcccatcctgaactctagcactggtaaaatgccttccaacaatgcaagccttctatctcaaaatgtatcgatctgtaggatgaaggtctcaaatggccaaggcaaccggtggaatgtggaccacaggctcctaacatgagctactacaaggcagagtgacctacatttcttggctaccagatcaatgtaagcatgtgtctttgggacctgtcatgaacatgttaattatggtggctcagctgtctagacagttcaaactttacaacatgctctgtgagggtcaccaagtaggggttatggaaaaagaaggcaggtaaaattgtacaaaatacagatttgattaagccccaatgtgatctgaagaagagtgagtgagctagttcaagaggtttacccctcttaaaaacacaaacacctcaatacatgaaaacatgggtttgctggattcagggcagactagtcccttaagatgataattcttatttcagggtttctttaaaacattagttttgctaaggtgtaatacaagtgtaccacgtttacatagaatttaatgaattagaaggcactttcacacataatgtatcatggagcgactctgttataggtttttgatgcagaaaaggaaaactggtttcagagaaggtgtttttcatcaaagtcattcagctagtaagtggtaaagaacaggaaagaaccatagcttctcacccctggctaatcattctttctcctcttgtttttcactgcttccttgccaccaatacaaaatgtgatctagtttacagggggacaaattcaattaacaaagtacctttaagtgcagttatcttttgacagagggaaaaactagtgcctatcaccttctcccctctgaagcacagctcatggttctaggaccaccctgaccagaaggaaccagaaacaggtgacagttaaggcaagtaccgtctggtgaaagaccattacgtatcaagtgtttacaggaatcccttctcactgcatggttagcccatcctgactggcctgtgtcatgctggttttgaaatatttggaatatcacctccattgacaatatggtactaattttatcataagaagggggtgggttgtggtgtatggacaaacaaaaccttaagattggctcaaagattccaatatagtctcaaaaccaaagcattccacagcttcatcagcaggtggcacacatagccccataatcttattctaattttctcatttccttgattctccgccattgtattcattcttttatataacatctccatcccaaaaataaatagcgctgtttggaggttcttctgattcttaacaagaaagaatcatcataaaccaaaaatgttctgccatatgcctaaacctggaaattcattttgcaaaaaaccaaaacaatgaggttaatcccacaaatactcaactattttatatcattagaatcaatttgattaaagtgctaaaataatttgcactttcttcaacttcataaatctttctgttacaaaatatacctgatagatcccatttatttgcttattcatttaactattacatttcttttcctttgcatgctgttgcttaaaaatgcttaacatgcttagctcactatttaaacagcatggaacatcctgacttggctagtattgaatatactgatccccacaccccctaccctgcaacacatacacagttattaaatgttgtgtatttcccaaatcttccgggtattttaaaactcagtgttctcggaggtcttaaaatgcgactctcacccactttttcatctccttacagacaacgtcactgactcattcttagcttattataatcggccatttttacttcccttttcaaagatgccaaaagcaaccatgagctcaaacatgttataattcttgtgaccactgtctgctacttagttcaactagtgtgtcaacatgagaccaaacattagggtcagacaagggagatgtacactgaacagaactcgccagtaatgagctgtcatgaaggactattaaaaaagcaagacccaatttgctgacacaggttctaagggtgtgaaaagttggtgtaattgcccaagacagaatttatcaggcattttttaaagcaaatattttatgagaaaacatttttatagaagtaatgatgccctttaggaagtgtcattaggacatactcttgcaaatctggggtgattaaaaagcacttagtagctcagggcctctggtgtgttgtgatataaaagggtgggtataatgcacacttcatgtgtcatttgcttatctaggcagggctctgatgcccgtaacagtgccaaggaaagaaggttgcctccactgaacatgaagagaccaggaaagctcctgtgaaggtaacaaccttagaaattcatcagctaaaagcatctggtggaaaatgttaaagatagaatatgtagaaattgagaaatgcttgtacaagaggaaaaatctaccagaaatcatcctcctaagagcctaggtatgtccaactgtttatggaggtattatgtaggagagaatggtgtaatggccaaaaacacagcttggaatcaaattgcctgactttgactcttggcttttgccactaaatggctgcgtgaccttgggcaagtttcttaacctttctgttcttcatttgcaaaacggtaaaaatcatttctaggcttgtttgaatggtaaactgagtttatctgtgtaacgtgcctagaacagagagcagtaacagcttttattagccactttgtatttggtaggaaatacaattgtacaatttgacacttgcttacagaacccagactcttccttaaattagctccatgtgattagtatggattggtttggtcagagaaatcataagcaggtggaattgggattaacaagtaaaacgcacccttttccacaacattttctgtcattacaatggcacgaagtaatttcccttctttgactcctgcaacctcttcctgttctcatgcctcttctttctctacccttaaatgtcggaattcccccaagctctgtcacagcatgttggtcaccttcttcagcattttatcctctcctagggctccagcaatgacttctttgctttgactctcaaatctcaactgtcagcccaaatttgctccctcatttaaaactcccttcccctggcgggggacggtggctcatacctgtaatgccagcactttgggaggccgaggtgggcagatcacttgaggtcaggagttcaagaccagtctggccaacatggtgaaaccctgtgtctactaaaaacacaaaaattagccaggcgtggtggtgcacacctgtaatcccagctactcaggaggctgaggcaggagaatcacttgaacccaagaggcggaggttgcagtgagcagagatcccaccagtgcactctagcctggatgacagagcaagactctgtcgaaatgaaatgaaatgaaatggaacaaaacgaaacgaaacgaaacaaaactaccttctctcatccttgagtccaacatctgtgggcagccttcatgaccatctccaactagatttgaactgtatcaagctccatttccttcccagtaggacacacgttcctcttccatgagctcactacatcatcaccctctttcttaagctcacctttaaaatacctcttaatatactcccacctgactgccagcatcctagtccagaccttcacagttactgtgcacaggagttttctcctacagacctttactgattaccttgttctaggcactgaggttctgggccccacacatgggttcttcctcctaactcatcccagaatcattgaccaacacttgcttttatttgtatgaatgtctgagtagttctttgggggcagggggaagtattacttttcaaattttgtagggctagtcaaattttgttctttttttttaagggctaaattaataagtactttaatataaataatctcatggatttaggatatcatacagctgagttatgtcagatactttgaccaacaatttgcagataaaagcacattatttgaataataaagaaaagtggaaacccaatagggagaggttctatatttatccaaattaaaaagattaattttcaatacatagactaaagctgtcttaaaagaatgttcattttccacactcccaggatatagcggtggtgggcttatgcgctactaggaaggaaagaaacacagctacttcaaaaatccaaccccaaccataaggagcagtgatgtgcgcacagcagctaggttagatcaagggaagaaattagatttctaaaacaggttggatgaagtagtttattgacagtactccctccatacccagcttatcaccctttcttgttttattttattcctatgtcactaatcaccatctaacacgctacctatttggattatttttctgtttattgtctgctgctccctgcccatggctttttttaaaactgagggcaggattttttggtctattttgttcattgtttagaacagtacctagcacatagcgccaatgttcaataaacttttgtcgaataaataaatgtgaaaggatttcccttctagtggatttcttttatatgcaatactgtttgtaaaactcttatggaaaagaggacgctcataaattactttaaaaaaacaacaatagctctgccactttaagagaaaattcttccaaataacatgattcttgaatgttaactgtttgcagaggagaaaaaggaaaaggcatgtgttttgtgcccacctttccagagcacacctcagattcattcctggtgcttctgacaagatcataaggaccctgttgttcaccaaatatgaagaaacatacagcccagctagttgttcactgaagtcagaggcagcaagagcaacaaagaaaaaggcaaagtaaagatgctaaaattaaaaatttgtcttggtctgtgtatgaaggaaataccaaatacacattcatcctgatagtagattctggtctaacatgcataattatagcctgtcaaggacataatgtatctctaaagtaattcatgcgtctgtttttggaagctctagtaatacattgctaaaaactctgtaattccatcttcaatagggctttgtactacaacaacctccaaactaacctgcttgctgttccagctgctattttgatgactttctttttgtggcataggaaggagctaagttttccatattaagaatgcatatattaaaaacaaactaactacaagaccttcttgctgttccagctgctattttgatgactttctttttgtggcataggaaggagttaagttttccatattaagaatgcatatattaaaaacaaactacaaagccaggccagtggctcacacctgtaatctcagcactttgggaggctgaggcaggaggatcacttgagcccaggagtttgaaaccaacatgggcaatatagtgagaccttgtctctaccaaaatattttaaaactcagcaggctcatgtgatggcacacacctgtggtcccagctactcaggaggcagaggtgggaggattgcttgagcccaggaggttgagctgtagtgaaccatgattgtgccactgcactccagcctgggtgagacagcaagaccctatctcaacaaaacaaaacaaaacaaacagacaaaaacaaaaacaaaaaccactacaataaagcctcctcaattctaagacacgttactccttcaaataaaactgtactgacaatattttaaggtatcctatcgagtatatattaacataattatcttttctgatacaatgaagtggaaatactctgtcaccccttcaagcaatgtgtactatgagtcaccaaaacacatgcaattaggtgacaaatactaacacctagaatattttaatcaaatatcactaactgtaataatggtggaaagtaaggaaaaggaaaattaaacatgggcaataggatggtagagttgaaagatgtctaaggagtcagaagcctcaggttaaaattctaatgtagttacatattggctgtttcatcttgggtaaaagtgactgagcacaccccctatgccagccaccatgatgggccctggatgtaaaaaggtgaaaaaaaaaatacaattcctttgctggaaaagtatattcacagggaaagttctaactcacaatactaaacatgtagttctaaattttaacttaaaagctacagaacccatttataccaaaggtcagttaatccacatgaattgctcatgcttaaacagcatcaagggctccttcctcttcagggaataacaccttaattttctcttgcggacccactctcggtccatgtggtgtgcatggagctggcactcccctacgtctacccctccaggtatgggtatcaaggctgactaagtggaacatacaatcccttagtcacggggactggtccagaaataggcagtcacacaagccatgctaatgagatgtaatcccagaacttttgttagaactgctgcaaagaagatagtctgcattccactgggaatggcaggctatgtacttggagttgctatcttatcaccacatgggaaaagctgactttgaatcataccaagacagaggaaaatagagtcgagggatggagagtgacatattcctggagatgccattggaacatccggattcatccatttctaaatccctaatacaccggacttagttacttcggtcagtatggtctccattttgctaatttagttggagttggatttctgtcacttgggatcaaagagtcttgtctaatactcttttttaagctttagattcttgatctgcaaaataaggcagttgtgtctctaaaattccttacagttctaccattctgttacagtactgaatttaccaatttcactgggctgctgtgatgatcaaattagataataaataagaaagcactttgtcaattttcaagtgctttacaaagagtacgactggctatgaaaataatattcaaatatatgtgtatttgtgtgtacactgaaaaattaggaggctccagagtccattccatttgtaatatagttatataagaagcatagactcagaaaacaacaaagaaaaaggtctcactcttgtgcttctctcttaggaaattcacattttaccaaatctcaaaggtttctgctcataatatcttgtcttcctaagttcattaccaaaacccagaagggtccttttctttcacttaaaaaaacagtgcctattattttccactttatttccataaaaatgacattaaagtgctccttggggatgttttgcaaacactttcaatcaccaatcactgactctgaaaaaaaaaaaaaaggaaaggcattttattttccttcaaaggaggaaacaaccctctaataatgtctaaaggggaaaagggctctataaaaatgggcgccgtgaaaaaccatggaaaagataaaagaagtcagggttgaaggacattcttcactgggtctcttcctctcatcaggcaccttcttaacatccaggtgcacaagccccctgcagtctagcaagtacaccttccctttcaggtctgcacagctgcacagtcaggcaagcagctactagagggcagcaaaggatcagaaatgggagtgcagggctcaggcaggctggctgggaactgaccagacgaccaaattgaggccagatacttgaagacaacctcggtccagtttcccatcaaaagacaggaaggatcatgggatccctctaagttcttagatgagtataacaaagcttgtgttgacagtaatccaaaaatttagcacagtatctggtgacagtaacagaggccgagttgtcaagaaacgaggggcacatgggaaagccaagggggagccgaagtccaggaaaagcaggcggaaggtcaggggaacctgggttctggtcagaattctgggaaccaatcaagtcaatcattgtcattgtcatcatgatcatcatcaacatggctagcactcacttacttctctgtgtgctagccatggcttaagtctatatatacatttcaaaaggcatatgcaggagaaacatttttacctagctttactgaggtgtatttggcataaaataaaaattgtatatattcaaggtatacaacatgatgatttaatatatatatacactgttaaatgaccacaatcaattaacatattcatcaccactcagcattgatgtgggtgtgacgggggtcatgagggtacttaagatctactctcttaccaaatttcaagtaaacaatacagtattattaactatagtcaccatgctgtacattagatctccagaacttattctttttgtaattgaaagttcgtaccctttgatcaacatctccccatttcccccactcccagacctctggcagccaccattttactcttttatgaattggacattttaatgtattgtaattttaaaattatttatttttatttatttatttatttatttttgagacagggcctcgctttcttgcccaggctagagtgcagggatgtgatcatggcttgctgtagcttcagcctccagggctcagacaattctcctgcctcagcctcctgagtagctgggaccacaggcaaatgccatcacacatggctaatttcttctattttctgtagagaagggctgtccctacattgcccaggctggtcttgaactcctgggctcaagcaatcctcctgccttggtctcctgaagtgctaggattacaggcgtgaaccaccacatccagccaaatttgacttttttagattccacatataagtgagatcatataatattggtctttctgtgtctggcttatttcacttaacataatatcctccaggctcatctatattgtagtaaatggcaggatttccttcttttcattgctcaataatattacacacacacacacacacacacacaccacatacaccatattttctttatttactcatttcttgatggacacttaggttgtttccacatattggctactgtgcaattaacacggagggtacaggtgtcttttcaagatgccgatttcatttcttttggatatatacccgcaagtgggattactggattgtttagtactatttttaattttttagaccaagcacgatggctcatgtctataaccccaagaatctgggacgtcaagtcaggagaaccagctgagctcaggagtttatgaccagcctaagcaacatagcgagaccttgtctctaataaaaattaaaaaaaaattttttcaaaaaattttttttaatttttattagagacaagttctcgctatgttgcttagaaaaattaaccaggcattgtggtgtgtgcctgtagtcccaggtatccgggaggctaaggcaggaggattgcttgagctcaggagtttgaagctgcagtgagctatgatcctgccactgcagtccagcctgggcaatagagcaagacccagtgtcaaaaacaaaacaacaaaacaaaaaaacctccatactgttttccataatggttgcactaatttacatttccaacaacagtgtaaataggttcccttttctccatgctagccagctatgctatttgctcaacccaagaaatacaagaattagtcaagggtaattttcattttatgagatttttgtttcatgctttaacttcagaactaacctccaccactcaactccagtgcaaccactactaaattcaatgacttctaaaccaaaccttatttgtcacttctcatagtcaaggtttttctttaaggaatgtgccttcagtcatttgtatctgtggtcctggtggaaggcaaaagcacaaactattagaaacattgggtttgttcaagtgctgtgatttgtgcttaggctgaataagaaaaactatcaaatgaatacactagaggtttcttccataaagcaaagggaaaagtctaaatatttcattaaaaatacaacagggaggaatttactttcaagtttttacaaggaattaaaaaatacatatacttttccaaagttagatccatcaacttttacctttcttgttatatagatctctgaatggttcttaatggttgcctacgttatcaagcctggaattcgacaatgctcccaccatgcccttgtccactcattcttccgaaagtttggttctaagtcccagtggtgaatgaaagtgtcctctttacaagcatcttttattctaaagctacctttcttttgcctttatatctaatactttatttttagaaatgacattaaaattagtccctaggaagagagtccttccatagattctctctcttaacttgtttgcgtagggaaatgcaggcgcttaattgatcaaaagggactcacagaaggatgaactattttgcagaagcatgctaatggaaatgcaccaaccgctaagacccactgctcacaggaagcatcataaaactggtgagctgatggaagtgcaaagctgtaaagtaacagccaaatttatctttttttaaaaaataaaaggtatcttccaagtagaaaattagagaaccatttgatataattcactgcatttgacagctttggagtagatttataccctgcttttttcctcccaccttcagttttccattatcaatctctcagcagggtttggatttcagcattggcaccaatagacagaactggaaacaagtgcattctgcaaatcactgcatgctcccatgtcataatctcaattctcattcctcagatacagattctaggttgcagctgcagattaaagtcaattctctaaaattacaactgtaatttctcacttatttcaggagttccaattgtgtaaccctgtaggaagtttcactcatatgaggaagttcaaatgaaacagaaatttgagtggagaattaagctgtcccttccttttttggcactgcgtctacatggcatcttacaactctttgattgctgtgatgacaggcagggccaaactagtcaggagacaaaagacaaggccatctatcaccattatttggaaatttcatctagcaaaggatttatgatctgttcattttggaggagatttaaaaaaaaacaaagattgaataaagtatgtctggtgatacatgaaaatgagatgatgagatggattttacagaagacctggggctgactgcatttggtcagaagtgccacattgtcatggcagagaggaggggatttgtctaggaccactgagcaccacagctgagagttctttgaaaaacaaccagtacccagagtatcccagaggcagtcaggacagcacagtgataagagtgtgggctctgggaccagactgcctgggtttgaatctaggaaatgagctacgacaagttactaaatattcctgtgcctcagtttctctagctactcataggattattacagaattatttcgtaagtcatgacttgtgctgaggagtcctgacctagaacagtacctaacatataacaaatgctggaaaccactgtaacctaacttcatagggtgttgagaatgttacaggagttatgaataaagtgtttaggatagtgcttgatacataaaaagtgctagggtgttagtcattattactatgaatgttgttataatagtaaccaataattagtagtaccagagttccttaacatagtatgtcccaagagagccaggtcatgagcttatgaatgacagggtgatgtctaaactcaggttatcaaactggcagctccagggccacacgtgacctgtaagtacgctcgttttgcctgagctatgtttagaaatgttttaaattatttgcacacttcagaaatgtctatagtttatttaaagttatgggtttgtggattctctttaaaaatcaagagctcatttcacattgggcctgcattcccgcatgcaactctcagttggggctggacaatggtggcctctttggatatttggggcatacattctccaggtcaccccagtccccactagggttccttcattcactgttatctgcctggcccttgtaggcacctgagtttgctgtccttctcccttgaatctattttaggccttccggggtgatatgctctcagacagaatttttttaaacacattctgggcccatctgagaatatgattttactggagctctccccggtaaaatgtacacaaatttatatgctcacatgacaactgcaagtggaccacggactccctaaagcccattcatgaaaaaatttcctgttttatgggtctattcatggacaagaaaattccattaatcctcattcttcattagatcactattgtatcaaggcgaatcccatgattttaaaaatagaaattatacagatacataaaatgaaggactatgctcaggaagagtaaatcctttgaactgatgataaatttagtggttgatttgattgcactcaaatttggcatctttataacaaaacaccacaccaacttgctatctaatttcacctcctaaacacttctcaattctgctacctcttctccagatttcttagcactctcagggccactgccagcccagacggtactattatgagcatcagaaacagcatctcttcctcaagacattttactgccatctgctggggaaaatgtgtcatactaactacatagattcatcacatctaagatgagaatgccacatactagacaggggtccttgaggagtgcacacctgcagaacagtttccagcatgatttgagttgtgagcatccctgacatgggctaagcatttctacttgaggccattatccagaggaggcagcagagagtggccattatgagctttgtagttttgagtttttaaaaaacttttttattttgaattacttttagacttaatgaaaagctgcaaaaaaatgtggaaacagagagtttccacatatcctttacctcttccccaaggagatttcatcctataataataaaaacaagggtttgaatcatgattctgataggatcttggcagatgggcacagtgccagctcacagtaaatgctcagtacgtattattatatgttgttatcatctgctagcatcactttccttaactataaatgaagataataaaaatatctagtgtgaggattatgttacattattagtaaagtatttagcatagtgcgtgataaacagtaatactattattgatattgctggtgatattaacttattatttctgaggtctaatattcttccccaacccacagtcacctagtacactgacatcctggttttctaagtataaaattataagtcattactattcctgagatgcttccatatcccagggaatagatgctggtaaccagttcccggattaccacagtagacatcccaaagatcaggaaatacccagagcctaagggcagagctagttgcaggctgagggtatggctaagtgagatctccttttgtgtcttatctgaggtccaacatctctctgaagcactaaagtcttactgataactgttgttgttataatttcataaaacaaaggcaaatctttttaaaataaggaagaaagctttttattcccacttccaaatcatctgtctctaaccaagtcataaagaccatcaggctgccagtgcagtacgatgtgttagatgttcaacaggagttcctagaacaggctctacctcctctgggtggagaagtggggctgaccatgtgtgaggaggagccttgctcatagggggaagacacttttctcaaagcactcctcaactgctgacccagcatgcaatctaacctgttttttttttttttatggcatctgtttacacaaattctgaccaggtggcaaattcttcccctctcctgtcagccacagtatgctggacagagaacacctgttccagaagtggactgattagcccaaggttgggatacacagcacgagctatgggccacacgagaggaggagatcctgtgacttgtcggtggttggctccactcctcctcttggccctagtccatgtctaccactaatgggattgatccatgggcataaatctgaaagcccttgctaggcaggtaggaggttatcttatccaaaactgctacagtgttgttgctagctgaaagcaaatgtttcaagcactggggagggaactagaggtacaaaattgaggttgataatcttcgtttttaaggagcttcttggggagggcattggtgaaggtgatagaatggaataaaaatatcacttaatgaatatcttttctgcaatgtcatttacatatgcagggtatctttaaacaagtaacaataattcagtggaatatcagctttattgatactatcagtaggatgtgtggatgcaaaagggagaaaacaaattagtgagaagaatggataaatgaggcagtaggaaaggttcacagaggaggtgggactggaggtggattgtgaaggataactaagagtctgtccatggtggagcaggcaaatattccaggagaagaaagaactggtagcatggggcaaatgggaatgaagcttgaaagaaaacggaaaaactaaatgaagaggggaagagagaatcaaatcacaatataggcataaaatggaataagctaatgattagcaaaattactattatctcaaaaccccattttttttttaaaggacaactcataacacttaccagctgtgccactctttagggtactttcacatctcaagaatggtcctttgacccagtagacatacagaaacacaagtcaacctattcatttctctcaatctacagaaaactctagctctgcaagctccttgtcatttgaagaatttgattcctgatgagtaagttgctagcctaaagaaaaataccaatctaaacattattaaggacagtgtaacaaagaagacattctacaaattctttattcctgatagtcataaagaggctacaaagagaatgagttagagaaaggtggaacatactcagcatgaaaaagaaattttaaaaagaattatggttaggccaggcgtggtggctctcgtctgtaatcccagcactttgggaggccgaggcgggcggatcacaaggtcaggagatcgagaccattctggccaacacagaccccgtctctactaaaaaaaacaaaaaacaaaaaacaaacaaacaaacaattagctgggcatggtggcgggcacctgtagtcccagctacttgggaggctgaggcaggagaatggcgtgaacccgggaggcagagcttgcagtaagctgagatcgcaccactgcactccagcctgggtgacagagcaagactctgtctcaaaaaaaaaaaaaaaaaaaaaaaaaaaagaattactgttatagattttgtgatccaagagggatgttaggcagcctgcacctaatagaatttggtagatgcaaaaaaagttgcttgttgaataaatgactgaatgttctacttcagtggtttataaactgtgcttcccagaggtggttctgggttctgtaaagcacaaagtaacttctgtacaacagtgaagtttcaaactactctgaagacaagtgtgatcccagtgcctgacatatagcaggtgctttataaacatttggtagtgaatgaatgaaggaacaagcaaatgtattaatggatagaggaatggaatagtttgaactttaacaaccatgaacaaaaggactaaaatctaaagggaaaaaagaccaattttccttctctcctgacctatctcaaactccatccttgctgtaacttatttccttttgcatcaagggaaatataaaaatgacaatgacctttccctcacatcagagagaggtggaaagaataaatatgttaatatgtgcaaagcttccagacttccttagagagagccactacaggtattaatttaattattatgagcttcttgcagaaacacagctgttacacctttaaacaaaccatttttgataatatttcagttatcttcaaacagaaggcagaatgggctagataaccatagggaaatggccgacaacacaaatgcacctggccctcagctccagactcacttggggctcaatttggggcagtcacacatttgagactactttttaagatacttttggttttgtggtgaagggctgagaagcgtgctaactggctgcactgagctgagtcaggcacagggatgaaactgatgcctctttctctgtccatagacagctccaaatctgaactaaattccaggagagaaggtgtaaggaagtgaaaagcaacagattcgaaagtatttttagtgggttactctctttgtaggaagttctggccttattcaaactatgtttctcatgtctatatattagacaaatggctctaatcagcaaatgcaaatcaagaccccctcaacaaagcgaagtgcaacaagaataaaagcttattgatcctcttgttatcgatctggaccatatatctagatttctctgtattctacaactagaaaaaatcttcagtatgcagtattaaatacagaaaagaattacggttacagtatttgtgatcctatatttgtagaaagcaatatgctttctacaatatttacaacaatcagagattaggagcttgaaaaagaatggagcacattgctaaatgagacttgtgccaccagatatggaggttcatgagatttgtctcaaaattcttctcttcaatcaatatgtatctagacttgaacatgcactgaaaagaattaacatgtcaaaaatgtaaccaggagtgaacaaagtaactaagatcacaattaattgtacttaatttagaaagaaagtgttttttacctgtcaactatggggaaacatcactttttagtatcaggacgccttgtgtttttaaaaaatatttgttgaagagtaaaagctgtacctgtgccttattttcatttgcacacaggatgtaaacacttgaaagttccaccatgaacccacattctacacacgcaaggcagaacttcacaaatgcttcccaggacagctctttttcaactatttcctatttgtcagtttggccaccaacccgcaagtctcctaggctagaaatctcggcagagttattttctcttttcttgccttcctccttccctgtttcttgtttgttcggtgaagataataatagtctggccccccacctcctttgttggctctagggtggtcctcccaccccatcccctccagaggttaatatgaatctacctatcgtatctagctgctctggaagcccagtaggtggaagcaccactcaagtcctctaccaatgttaccataacaaacttggttatttctttctttgactttttaaagcacagtttctggagtaagaaaaactgttcctactgtatgattgtgggcaaactcatattttcataagtggggaaaacagcagcctctacccttgcagcgttgttgggaggcttaagtgaagttctcagtcatgcagcaggctcagtaaatgccagctgttgctaccattactatcatctcctgtctattctcttctcacatcatccagccctcatccacacccacttcacactaggttaccacatgtgtcccacaagcagatactcatgactaaacaccatctttcccttggagtactggatactggatacacaaacacaaggaacagcctttactcttaaggagggtaagtctagtgtcccagacagacatatatagataattaaaagcaaaaatgcagtaagttagtacctggtggggcttctgtggttcaataactaacatttcttctttcttatcaaaggtcagaaacaacagagagtgatatggcttggctgtgtccccacctgaatctcatcttgaattgtagctcccataattcccatgtgttgtgggagggacctagtgggagataattgaattatgggtgcggtttccctcatactgttctcatggtagtgaataagtctcatgagatctgatggttttataaggggtttccccttttactcttccatttgctcttgactgccaccatgtaagacatgactttgctcctcattcgccttccaccatgattgtgaagtctcctcagctgtgtggaactgtgagttcattaagcctctttcagtcttgggaatgtctttattatcagtgtgagaagagactaatacagagaggtatataatggaatcaggcagatggcaagcaaaatatctcctttgttactaataaagctgatattgaagaaagtggcttagtatgagagttcaaagggctgaatggcacatccttactcacagggacttaagctgctaatgtcactagcagtgctgaacaaccacatccacctgcatgaggcccgccctgtagaatgaagggcgggaaggagtcaaggagtaccagctcccaaagagaagagagagggaggaactgagcatcacaaaggaacacattagatacctgagtccacctcctgggaggggcaagtcagggactagcatcatgcagcaaggcagggagagcttctcttcttctgcccaatcattagagattcagagtattgtagtagcagcagaagtgagtatacaacccagattgtggtgggggctgggggaaaccagagaaggaactcctgggggagtctcaaaggataaacaaacgttaggaaaataaagttagagaaaaggggaaagatgttccaggcagagggaaaagcatcagtgaaggaatggatctgaggcatggtgtgatgtatgctggagcaacaggtgctttgacatttctggggttttactaaaagttcagcctgggagtggcaaagcatgaggctggggaggtaggcaggaaagggatgggctgcggagcacatagagtggcatgttagagagtgggctttatcacaggtgatgggaaccagtgccagtggcagcttttttttttttttttaaattaagatttggggtttcaccacattgcccaggctggagtgcagtggctagtcacaggcatcatcacagctcactgcagcctcaaactccttggcttaagtgatcctcccgcctcaggctcctgagtagctaggatgacaggtgcatgccactgtgcctaactcagtgaaagcttttacccagagactgtgttttagacacactgctctggtggctgctaaggataggctgggggggagaatatcaagttagcttggaggatattctagtactgctagcaagagatgacaggggcctgaaccaggatgctggtatcagggagcaacaagacaggagggatttgagaaatattttggaggtatgactgacagaacttaggaaatgctttattgctgtctgaggctttctggctccatgatgtcctctttccaacccattctgaatcccccacgggctgcctaaggtcctgctatgggtcagccactatgctatgtgcttgacctacatgttcatcctcagactaacctcatgagacaggctaacctcattaataactcctgtctggcagaggaggaaacaggtttggaaaagggaaatctaagaagacctagtgaatagaagattgggttggaattcatatctaggtagtctgactccaaaacccgtgcaactaataaacacaaaccctcccttttctacacacatccattatggtcctactcctctactactttcccctatcacttgaattccaaagtgttcttctgggactcctctgcctcaccttaccccttcctcctcttcatagctgcctcttagccattgcttactctgatgcttttcctttgagtagctccaagctgcacgagtactttagctcaactactttagtagaattactttaataacacaaaaatacatttattttgtcaataggaaatatatgtacaaggtacaagacataaataatgtaactggaaatacagtaaaaaaaagtaaatcctctccaagatcctttctccagaggcaactactgttatcagtttatgaaatacatctggaaagatgtacaagaaacataccagaataaataactgcaagctctttaggctgcccatagaaaggcttctccaacttctaccttcaccacttttttcctcctctggattcctcctattatccacagtgcagtgccccagaattcagcacacaattaacctcaagttgtttcataaatataagccatgtctccttaacagcaatggctcttacatactaatctgagcattagacacacagtaagtgttcaataaatacctgctgatcaattaagcttccttgagttaaccctacacttgcttaaatggcgtatttcatgcaaacctttagctgaacccattcaaacagcctttacaatgattacttttgcagtagctatatacttaattggtcctcactctctttttagaactctaactgtacaagcagttgaaagagtgattttttaatggatgctgatgttatagtgaatacagtcattcagaagtctaacacattcaagtatcacagagctggtcatgcaacacaaattccaatgccactcagaattctggtcataaacgatgagaaaaagggagtaaaaatccctcctgtattacccgaagaacagtattatttctgccattttaatctgtttacactaggctatatactctgttgggctaatctttaaatattggccttattatattcatgatattccattaaaaggcaagcaccagatgcatttaatttactcttcaggggtatgattctcagataatctgtcagagaaggaccaaatgcttctttcactgtgatgcaatgatatttctatctaatagtgctctagaattatatttcctccccaaatttgggatctcttatgctaaattctctgcttttgttctcttgacagttttcagtcagtttaaatacctagagttctgctttcaaggtaatagttttttgatttttatttttaatgacagcaaaagttctatgaaagagttcatgtatatggcttgctctgtgtattttacaagcccaaagaaaattacatttcagagaaggtacatatccaattactaggaaatgagttacaacaaagtggccacagaagcagtgtaataaagacaacctcaattaaaaagtctccctaacaaagcaaaaaagagacacaatgcaatgcacattaatagcttactcaacacctaaacacagagtgggtgacaaaaaaggaaacgtctctctggtacaagttaatgaatcattctacttaacaagaggaggtctagaaaggggtaagggtcttttctgcaatcaatagaaaggagcagttagaattcaagagagaaaacaatacagtaatcttgggaaatattattttagacaatacttgttaattttaaatagttttaaagaaacaccatgagataaaagaagttaaagcaagcatatgtattgtgccatatacaccgtactgatgacagactgagctcctaccttcacgggacctttggaagatggacatgtaagtcactgcagtgttgggacttccaggatagagtctgcaacattgcttgaagcacagagaggagatctaatagccgggagaaaaggagtagagcagatgagggttctaggcatcagcaaagatatggtgccttgacagggactggcccacctggagtgtgaatgtgatctactaaggcttaagtttgcttgcagtgtatgtgtgtatgtctgtgtgtgcatgcacgcacatgtgcacatgcagcagggagagtggaattaaggtgaaagagtagtggatttctaagaccttgccaaagaatctgaacttcatcccaaaagtcatgaacttcagaaagattttaagccagagaagaggcatgataatatctatattaaaaagacaatcaggtagcaagtgtggaggatgcatgggagagggcaaagggagaggagggaagatccgctaggaggtggaggcaatcattcctgctgtaggtgatgaggaactgaaaaggagcagggctcatgatgggtggaaagaaagtagagatccaaggaatatgaatgacagaggatcaacagggcaactgacactgatgggtgtcaggagaggaagaaagaagagtccaggatgatgcccaaacttgatgctttggtgactggtgaagggtggaacactcattcacagaacaagagataagcaaggagaagcagccaaaacaacaccacagatatgtaaaattaagagtatcaactttaaacaagagccatgggttgggtgacattatgcctactagacattaagatatattacaaatccatagtaatgaaaaccatgtgtgtggggtggggagagggaaatgaggagttagtattgatgattgcacaccactgtgactgtaacagatgtcactaaattatacacttaaaaatggttcaaatggtaaaaataagaaaaagggaaggaaaaaaacacaagtgacaaaggtatgagaaggtacccatgtgtcaataaaaaagaatagatagacctaaagcagatcccagaataaaaagaatatagtagatgacaataaaaggatatatttatatcaaagatatagatggtgaaattgactaactactccaaaatatcaatttacatacatcacacaaacatcaaaataaactttagtttgataagcataacatgtaaaccaaaagaacataaaatatctagaaaaacatttaggtgaacatatcatcttttgatgaggaaacattttcaaagtattaaagcaatagaagaaattattaaaaaacagatttttataattaaaaaagctaatgttaaaaattcaaatgtaatcagaattgtaaagaattttatataaataagaaaaatgttaatattattctataaagaacacatgtggatcagtaaaaagatcactaacaagcaaatggaaaaaatggacaaaagatgtgaagaaacagtgggggtaaagaatcaacacaaataacaaataaacacatgaaaaactctttagtatcacaagtaatcacagaattgtgaaacagaacactgagatgtggttttcatctattaagtgttcccaagcactctgcagaatgtgtacccctacaggtggcaggaaagaggttaacagagtatcactttcccagagagcttaagaaccttaaaaaatgtttcttttctctcacccattaattacattggaatgatttatcctaaagaaacacagccaagatttttctatatcatttttcttcttgcttaaaaataaaagcacttgttgatcccttcctcccattattcctctagataattcctccatttcattcaagtctcagcctgtctctgaaccttgattgcactgccatctctcttgtacactgccatagcatcctgaagtcctcttcatgcatcttattatgcttgttctgacaatagtttgtctttctcttgtctagatgtcttatctaggcagtaagctccatgaaggtcttctgctctattacaatatacccatcaattaacagagcccttactacaaagtacttgttgaatgaagggatgcattaatgattagtaagaagtagggctgaaatcatttttacttttcttttttccctaagattccatgacaattttatgggacttttctattaagaataacagcaatggaagccattcaaaacagcatcctttcatacagttcacccactgaactaaaagtcaatactctaaactgtgaaatagttactatgtaggtaaaactaataaaactatccatttaatgctacaaagagaataaaatacctaggaatacatctaacaagggatatgaggagcctcttcaaaaagaactacaaaccactgcccaaggaaataagagaggacacaaacaaatggaaaaatgttccattctcatggacaggaagaatcaatatcgtgaaaatggccatactgcccaaagcaattcatagattcaatgctattcccatcaaactaccactgacattcttcacagaattagaaaaaactattttaaatttcatatgaaatcaaagaagaccctgtatagccaagacaatcctaagcaaaaagaacaaagctggaggcatcatgctacctgatttcaaactatactacaaggctacagtaaccaaaacagcatggtactggtaccaaaacagacatatagaccaatggaacagaacagatacttcagaaataacaccacacatctacaatcatctgatcttctacaaatctgataaaaacaagcaaaagggaaaggatctcctattcagtaaatggtgttaggaaaactggctagccatatgcggaaaactgaaactggaccccttcctcacaccttatataaaaattaactcaaggtggataaaagacttaaatgtaaaaccaaaaccatgaaaaccctagaagaaaacctaggcaataccaatcacgacacaggcataggcaaagacttcatgacaaaaacaccaaaagcaactgcaacaaaagccaaaattggcaagtgggatctaattaaaccaaagagcttctgcacagcaaaagaaactagcatcagagtgaacaagcaacctacagaatgggagaaaattcttgcaatctacccatctgacaaaggtctaatatctagaatttacaaggaacttaaacgtatttacaagaaaaagacaaccccatcaaaaagtgggcaaaggatatgaacagacacttgtcaaaagaagacatttacatggccaagaaacataaaaatgctcaacatcactgatcatcagagaaaggcaaatcaaaactgcaataagataccaagtcaggaaacaatagatgctggtgaggctgtggagaaatagaaaggcttttacactgttggtgggaatgtaaattagttcaaccattgtggaagacagtatggcgattcctcaaggatctagaatcagaaataccatttgacccagcaataccattactgggtatatacccaaaggaatataaatcattctaccataaagacacatgcacacgtatgcttattgcagcactatttacaataccaaagacatggaaccaacccacatgctgatcaatgatagactggataaagaaaatgtagtatatatacaccacgcaatactatgcagccataaaaaggaaggagatcatgccttttgcagggacagggatgaagccggaagccatcatcctcagcaaactaacacaataacagaaaaccaaacaccacatgctctcactcaaaagtaggagttgaatgttgagaacacatggacacagagaggggaagaacatacaccaggacctattggtgggtggtggctgaggggagggaacttggaggatgggtcaataggtgcagcaaaccaccatggcacacagatacctatgtaacaaacctgcacgttctgcccatgtatccctttttttttttaagaagaaataaaggaataaaaagaaaataattactaccacttaagtttgaacaaacaaaaatctatttaagatttttaaaaaatgttctttagtagggaaaaaataaaaacaaactcagccacctttcaacttgcaaactggctccccatgcataaagctgtccatgttatgttcacccttctactctgtaaccttctactctgtccccaaagtccacatgctcttagagacttccaaaattagaagcttcaagtcttctaagctgtagctgtttctctgagagcttcccataattggcccttagatagtgagatctaaggaattatttattattactgctgatttacacacttattttgacaggttaaaacataccatgtaagtaagcaacatgaataaaacgttgcttacattcagtctctaatgtacgatttaaaattacaaacacaatccttcttctctgagtagcagtgacagaccttgtgatttaactgtctgcgccaatcactgactaaaaaaaaaaaaaaaaaaaaaaaagatgtggaaaacctgtgctgggctatttagagacgcttaatgtccttggtctctcctagcacttcaagtaacacttctttttaaaagaggtaagattttttgcaagtgggggaaaagatggtagcaaccccctccctccacatccttcctgcatattcctcttttacaaagttggatgttggtgaaagtcttcataattcaaccattcctagaattattttcaatgccctgtaatgctgcgtactgaaaacccatcttttgctagaacaaggtcccatcagttttaaaatgttacatgttactgttttcctgaataataaaaaagaaattactagtgtcattaaacgtacatttgaaatgagacactatctggatgttaaaaaatataagaaaggcaggactattctaattatgcatagtactgaatgttagtcaaaggtccatcttgcgtgggagaggttattaacaattgtttaaaagaaatagaagaaatatgcatttccataatagtgtctattctaataatgctgttaatagtctaaaaggacatcttttcagaattccctgttaatatcttttgaatattctcagtgaactggtccataaaatctcagtgctctccaacataactggaatgtctcctgggacacatggatttcacagcatatgcacacagtagggagaatggaatgaggttgctcataatgcttttttacatcaataattgataaacagaattagacacagctccccaaggaatcaggtgtagcaaattacaggtaataaaaacttaaagaaaaaaaaatcctaacccctgtctaaaattttatttgtttaaactcgagctacctaatgaagagtgtctttaaggctgttaattcaaggtgatggtaaagtttaccatactagaattatattttgttagttcacttttaagttctgttaggatattttcatttgtatcttattttcttagttcgggcctaggtagaaaattaaaacagtatgtcaggtagaaaaagagaatatagatgaatatgtttatgcaaccagactaattttgtggtcatctatgatgaaaatacatgaaattaggttatatttatgtttaaattatatgtatatacttaaaaattatatgcatatactttttttattatactttaagttctggggtacatgtgcagaatgtgcagttttgttacataggtatacatgtgccatggtggtttgctgcacccatcaacccatcacttacattttaaaatccacaaactgaagtttatatttactttttctttgaatgccctcaagtaaatttagttgtggttgactccctctactggcaaaaaatgatattttttgaaaaaaaaatttttgtcaagaagttgacacgaaagaaacataatttgtaagctatcagatatattctctctgataaatattaccatgtgacatgatttttacaaccagaggaaattaatataaaagaaaagacagtagaccatcatgaattagaaaaaaaatgaaaaataagataaaagctcccacagcatttactatacagcaaataaaaagaaatactcaaaataaggcattttgaaacaaatttcagtgcttatccaagtagtcgttcagcttattcaaggacacataactttttaaatgaatgaaaaacaacatcttaggatgtggtctgagatctgtgagaagaaaaatgtttttgctcagtgtgtttttatcagtaacttcaaagaaaacttcaaaagcactcttatgaaaagggaacactcatgtactgttgggttaacagactcagaattcaaaaatgatctcaacagagtggcatatggattgactaaagagaatcccttatccatgggttccaaaccaaaaactcaaagttgtttttcatccttttcgtggcaaaacctgatctgagctggcaagaggttgtgaagtctgtatttgtcctacttagtgtgaatattttttctgtttcactgcattcatgttaacagtttgatgacagggagttgttcctagggttgggcgggggtagcctatgtatgtaacatacagtgaacactggggaaagggtactgtgttacctttcaaaggctgatagtacaagacaacacatgtgccttaaggatttctgataagagattgtgaacatataaaaacatgaaactaaaaaaagtaaatgtcagtactcacctaagtctaacaatttagcagcacaagtgcaggagcaaaagactcagatgaacagaatatttaataaaaggggatccgtttataggaagtttataggaagctgctattttttgaacacctactatttacccagacctttgctatttaggtattttgtagaatatcccttaactgggatttgtctgatatttttctcatgattagactggaattatatgttattaggaaggaaactaaggaaacgccattctcatcacatcacatcaaggatgcatactataaacctgacctttcactgcggtgatcacctggctgaggcaatggttgccaggttgctctgcagtgaagttcctctttttttctgctttcatactatattcattggaaaggagctactatgagtaacccacacataagaagtgaggatttatgttctacctctccagagtgtttttaaaagtagaagagggctgaattacatcttgaaagaagagaaatggctcaataaaataaacaaaatgcactctgccctttgggagattatgaactacttttggtaactcttaaaataataaatagtctctttaaaaaagtaagtggagcttcattgtctaaaccattctcaactgagaagtactctatggttatcctttttatgggaaacaagcaggtcagccattgtgcttctttcacatcttgaaaatgtcttattcttgaggtaagttaatatttatttgctaaaatatttgaatctggtatttaccaactcgattgatttgcttcaaatctttgtattaactttctcacatccattaacaaaatgcaggaaaccaatgcactttccttgagaatttactgttgctataacccctgagttaatgaccttaaatacaaagaagaaattcaactcccccgcccatcatgcactttgcaagacctttatgattacaaagaatcttaacataaataatgcaagatcgataacacagtaagccaaattgcatttaaaatattcatgcaattctttaaaaaaatacaaccacatattgctattcaggctaaggcctcttagggggaagagatacaatatatgaatgagtttgaatatctctgaaatgctcttatagaggaatcttccacaggcttctgcctttctggatcacttcacatagtatatgatagtagtacaaagcatagtgtttctaaaaatactagataatatggtatgtttggctcggatatggtagatttgtcttcaggcaatctgttgtgacttcatagagagtatcttttccttcattcttcatatatggtgatgtaatttaccagagcaatatagaaatagcttttggtattgatttagagctcagatgcataacctgatttagagcttgcttgctcagattcttgctattagaaaagtcttttcaaaatgtttggttaaaaaatctacttaataacaaaataatgagactatgggattttaataaagggtatccctaaaagcatccatttaaaaaggaaaaacaaacttcttaaaaatgaattcgtaattgatgcatgtcagttgtcattagtaaatacatgtctctgggaaatataattttgtaaatttataccaaaaattaaatacttttttaaaatttatgagcataattaaatcatcaagaaagttttctgaacatgatcaattttatctcaccatagatcacaaaaggttttgacatcaagaaagttaaattttgcctaagccatgacatatatcaataaagcaaaatttactgtgctcttagatattaaaaagcctaaaatatgacaggtataacatatatttatactcagctttgggattttttcttggtagaataattgagtgcacaaagatccaatccttggtaaatttatgtgtcttataaaggaaataactgtaaatccaagagcatgagtgcacaaataatggataaactaaaaatctacctaccaacaatattctttagggactcaaaattggcctgtctgggtctgccacaattagatctccatgagaaagtaggattaataatactgctaagaacactcaaacaattacttgccaagctgcgtgaacactatgggtcatagatcctaaatgagtaaatcaaatctagatcatttagttggtacgaaaagaatctcaaatgatttaggactttcatcattaaaaagtatatattcatgcaaaactaccacatgtgaaaaataaactgaatttagctatccaagaactatagtttactttttatgtagtgacaagttgtagaaaagtgacatttttaagaaacatgggtgctatcaaatcttaaaatataatacaatcatatacgtttcttaacattcaatgaaatgcattgtttccaagaagtttgaattctgatcacaatttatacttccagattttaagttaagcttggtatttaccaactggaaaatattttatattagtaaatcattatacaaaagtatggtacttttggtcaaaggtaatggatataatttatgcataaaaactaatattctcaagactcataagaattgggaaaatggaaaaacccttattttcagcatgaaacaagttaggatgtatatataggaatgttaaatgacttgtggagccaggtagtatgttcacatggctcaggttttctgcttcctctgaaatatctttcaattttgagcttcattttcagggaattgaagatgttagtgcatctttgtatagattttagtgaatctcacacacacacacatctatattaaatttcataatttttggcataaacattaaatgaagtcaaacataagcaaacggagaatatgcagatgaaatgcagtgagcaataatagtgtttgtggctggaactttatagaattgaggtcaaattataggctcatcctttgccactacgtgacctggggtgaatcactttcttcctaaatcacagcttctttatctgtaaaatatttgtcttataaactgttaggattaaatgagacaataacatttggaaagggcttggcccaaggctcagcacttattttgaattcctagtacttatcactatgtagaataatgagttttgcttgcgtgtcttcacttctaggcggtgaactcattgagggcaggggctacatctttttcatctctatattcctaggactatatcagccaatgattaagtctagaacaaatggtgtctaaagcatgatgagtgaacatgacatactcaaaaaattgaaactttcattaccacttctcttatccttgttataaacttttgagccagaaaaggtagaaaacagaccagcagactatttttcttccactaaaataacctaatatccttccatcaaaaatgtcatttattaatttttgtctttatgacagtcaaccttctactttctcaaagtagaagactggggagacagtaaacttgtttactcagagccaaagcagaaggtacttaagaaatagagcatctcttatgattcaaatgtctagccagtgattttcttcctcaacatttgtttattgatcacctattatgtgccaggtagtgtgtaaggtattaagaatagtgataagtacaacaatctctactcaaggaatttaaaatttaagaatgactgcactcagctagactaagctctgcctgagagtccccagggtgcttgtcaaaaatgcagcttcttggggtccccctcagaacagtagaagcagaatctgcagcagtagagaccaaaagtcaagatatttatctcttgaaccccccattcttggtgccgctgctcatgctgtgcagcttatctgaaatatcctccactgtccatcacccaccagacgcatcctttgttactcgactccagtgctacctcttcaaggaaactaccaaccattccttctctctcatagagttaattccttctttctcagactgtttactttatacctgtttttgttgatcagaaacttatcatgttgttatacatctgcttcccttactggcctagcagctctgtcaacagaaactaggtccttttcacctcagtatctaatacctagcacatagcctgtatgcagtggatggtcagcaaacatttactaaattataaatggaaacattttaaaagctccttgatagacaaagttgggaatttctttagagataggcaagggtaaaaaaattcatttaaattcaccctattgctcactctgtgacctaacacagtcaaattccccacactgaaggattgttttaacaagacatatcaattcattattattttaaaatttcttaccagatgtcttactttgtaatttctaagtccacaacttggtattctaaaccgatgtgaaacgttatctctgttttactttttaaatccacccatgatttcagtttggtctgatttaaacctactgaggactttttttagaaaatgaaactacaattcacgacttaaggagttggtatatttaggatatatttgaagtaaaaattttctatttacattttttatttcattgaaaatgatgatttaacttttgaaacactctaagcacaaaagactataagagttaatggaaatgcagaaaagatcagtgaaaaatataaactggcataatgatcaatgtcgttgccagatatgtcttttaagtctttcactttctattctgctactataaaagtttgtgccagaatctatttaaaataaatacattgcataatctcaatttgtttgtaattatactaaatagcctctttaaggagaccagcacaaaatgtttactccctttatagtttttggatatcaaaacataactattaaataatcatggcattttcatgcacaatttacaatgaacattaccttcttcagtatgctacaagaaaattatgtgtcattgtcttatttgatgagtacttattatgatgacctcttcaaaagcattattcattctgtacatttggtgaattctgttcaaatattccaggtagtcaagccagaaaatggggagtcagccttgattcatcctatctatccaatccatccatccaatccacccccctaccaactcacccatctatccattcaatccacccatccatccatccatccatccatccatccatccatccaatccaatccaatccaatccaatccaatccatttatacatccatccaacccatcagtcaaatcaaggttctataaattgtactccataacactctcttacaactcccttctccttcctatgcccacttccactgctctagtgtaggctttcatgtctgctttgtctcttccttcttcatcgacggccagggatccttctaacttctcagctgaaaaatcttcaactattttctactgccaagggcataaacatttaaactcttcagcaaggtgtacagggtctttcatgacctgcctcccaggttaactttatatttggccctgcccccttggacagtacttgctatactacttgtgctttctggagcctgtctcatggtcctgctctccccagacagtgctcatgctgccctgtccctacaaccctgtgaggagaagttcctcacttattggatgaacaaattcctattttagccaccagatctgaacttaaggataattctgccacagcaatgaattgtagcttgatgtgtgtgtgtgtgtgtgtgagagagagagagagagagagagagagagagagagagagagagagaactgtctcccctctagattaaacactgtgggcaggagcatttcttttcatctttgttgcccctgtaccaaaaggagagcctggcataaggaagatggccagtaaataccagctgaataaatcagtggttgtccacttcacctacacctaagactggtcttgctcagacctgttccagaaacaataaaaacattaaaatatgtagtaattgggaatataggcagagttataagcagcttaattaaaatacagtgggagctttgataaagacattttagatttagaagtttaagaagggaagaaatggtgactatttgaaaccatttaagagggttttccctcagaggaacattcatcaggccagctagtctctaggtacccctttgaccgaaagaagcatcgctcacccagcatgaatatttcactcacctatctatgattcttctcattgatgatgctttggagatttatttatacccatttctgctaaggaagatttgctgttggtgatatatttaggataacaggtattctcttatgaaaaatgaagtatccttcattttctgaggtcaattccccttaaaaaaattataataccccctcctaactttcctctgtaaggaagatcaaacgtgataaagtgtaactactttgagaagcattaaaaaaagatttattatttttattcccaacatatgtgaacacatttaatttgcattttttccttagtcaagtttaactgatttgagcaagtagaatttttaattagcaggaaagagattcaattgttttgatgattggtttcctcacctgaccatttattagaggctcctggggacagacaaatgtccaggccccactgcagcccagggaaatcaagacctccaggagagaagccctggggatttctgtgttaaaatttccccaagggtccatgataattagctaggttgaaaactgttactttaggtttctttttttttttaattttaataaattttgaaaaaaaaatttttaaattttattattattatactttaagttttagggtacatgtgcacacatgcaggtttcttatcctttaaggatttccttaaagtggaggcatgggttaagaatacagacatttgggccccaatagactgaattaagatctagatggttaacatccccctcccactcaccatgactctgtagtgacaggcacaaccaggtgtgtcaccacaggtgggaggcacttaggagtggcagaaaagggaagaaaatcgaggtggcaggtgggaggcttaaattccatgttttgaaacactttaattttttgacaccctcatcaactccatggtccccaactcttaagacaggaaactcaggcttgttctgagtactctagttcagctatttaagtggtctccactcttcatccttctcataaccaaacacagcccaggcaagaaatcaataaaattgctgagaacctgattactatttatataactctgcttttataacagaatatgttctgagtgccaaaaaccctaggcaggagtgatctttagaaacaaaacttattcttagatggaaaactctctcttctgttaccctagaaagaaaagtccaataagttatagaacatacatatttataacagcctgttcttatcacagaagaacaacaacttatggcagaaaattatttttcttgaattttgtagacagagggcagtatgtacatgccaactgtataagtaaaagcctatatgccaattttaaagaaaatgcttgctttatgacatctttgtgtaatggcccttttaaatctcaaaatattgtttagtcatttataatgggcttgaatttttgctcactgtaaaaaaaaaaaaagtcaccacatggcccaggaaggtgtttatttctttggcttagaaaatgtacgcatctgatgtcaccatagctttgcaaagggtgtatacacagatgcaatgacaagcatcgtgccagaaaactcagtggttaaaaatgataactaatcttgtcatgctctgtcattatgtaaatccaagaaatgtattgccaaagtgatttctattagtgccgttgaaaagagaattaaaaatgtaatcttcagcatatcattgtaagattgactctctctgtctgcttaggccttaaaatggtgatgcatattgaacagtcattgtgttggtcttttctttaactataaatgagattgcacttcaattcaatgtacccaattgataaacaaaattaaattagtgatgtttaaaaaaattgatttaaatcttactggtgttctagaggaagtctctcatttctgtgttttggttaatgcagctattcttggactacaagataacaaaatcagtagttctcctctgtaggaaacaatggggagatggcacatcttgtttcctgggtgtgccaggaaagatgtgttcctggacataggaacaatgatcaaatcagtgctgtgcagggtcatcacaacacagtttccatggagatctatctccggcattatactttggagattgcccttcaatttccttcaaatcccctaactagtctccaactgtagactcttcccactacatccacacaatggctggtcactcctccccggctgcaatgatgtcattcattaatgctcaggaattcctgccaccactaatgtcctgctgactctaagtcaccactggatacataagttgagggagcttctgctgcagtgattgccaaggtttgctccacttgttgagcctaaaaacctcctctaactccctcattttacaggcagaaaaagagagagccagtctggttaatattcagggtaatgtttctaacaatttcaaaaataataataactggaaataaaattaaaattattctaagctagttttataaaagaaagaaatccaagctgtagttctcagaacataggtatttccatgatcaattaagtttgagaagcagttggataaccaaaggtaagcagatttccttcttgcagaaatgttctctacatgttctttgtaggctgggtgcggtggctcatgcctgtaatcccagcactttgggaggctgaggtgggtggatcatctgaggtcaggagtttgagaccagcctaaccaacatagtgaaaccccatctctactaaaaatacaaaaaattagccaggcatggtggcaggcacctgtaatcccagctactctggaggctgaggcaggagaatcgcttgaagatgggaggtggaggttccactgagtcaagattatgccattgcactccagcctgggcaaaaagagtgaaactccatctcaaaaaataaaataaaataaatataaataaatattctttgtaaacttataggaagagttgtggtacatataaatgtttcctacatatttttgttcttttctcatagagcacctttgagatctagacacctgcagaacaaaagtgactatatcacctattgcccaactaagaaattttttagaataaaaggaagtatcttaatacttattactgggaaacaggcagaagctgggactgtcctggatggggtgtatggttaccatatagaggcaaaaaacaatacgaaacaaaacattttgaaagctaaagataatagaagagcagtcatagttctgtttctcaacttgaaggctacaatatacaagagtgaggggtactattctattttgctctagaagataataataataacgggaaaaaattcccatggaggaagaattttgcacaatgtgaaaagaactttttagcaagtacatttgtctgaaaagggaatgggttccattgaggagatgagagatcttccatccctcctcagggatagatgttaaccagtgagtgatggtttataagctaggagtaaatgacttctaagagccaactaatttttaatgattgtatcacttgactaataggaacttattgtaaatccctgagatagtatcacatttcaatccaaataaacaagattgtttcaggggaggactcaaaagtaccttataactcatctttttccaatttaccatttgatgaaaaactgtataaaaaattcactaccaaacaaatgaaacatcattaaatttgagtaactgagcttcatacaagtgaaaaaatactgaacacttttggccatgaggccttggtctctaaggaggccattagatttatgtaaaaattaatgctctgaaaatgcacaggggcagtgatgcaagaattaaacaactggaatgttcgggcttatgtacaatttatagacggacaaaggttaaagagtggaggaaaccttggggtcattctaattaagttggtacattttctcaacggacacaggcctacagatataaagtattctgcccaatatcacacaatgagtttggagcaggtattaatctgaataggacatgtagagaaagttaaaattattttgcctattctcacatactaaaatagcatctataaacaaattaagattaatttcagacattataaatgctgacttatctaattttatcaaaataggtagatacaggcataccttggagatattgcggatttggctctagatccctacttattgcaaattttggaataaatcaagtctcaagaattttggggtttcccagtgcatatagaagttatgcttacactacactgtagtctattaagtgtgcaataacattatatctaaaaagcaatgtacataccctaattaaaaaatatttcattgctaaacaaaaaatgctaaccatcatctgagccttcagcaagttataatctttttgctgatatagggtcttgccttgatgttaataattagggtggtgactgctgaaggttgggatggttgtggcaatttcttaaaataagacagtaataaagttggctgcgtcaattgattcttcctttcaggaaaggtttctctgtagcatgcaatgatagtattttacccacagtagaacttctttcaaaattgtagtcaatcctctcaaaccttgccactgcccataaagtttaagtaacattatatatctttcattgtcatttcaacaatgttcacagcattttcactaggagtagattccatctcaagaaaccactttctttgttcatccataagaagcaactcattatctgttcaagttttatcatgagattgcagcaattaggtcatatctttaggcttcccttctgattctaattctcttgttatttccaccatatctgcaattatctcctctactgaactcttgaacccctcaaagtcatttatgagggtaaaaatcaacttcttccaaattcctgttaatgttgatattttgaccacctcatatgaatcacaaatgttctgactgccatctagaatggtgattcctttccaaaaggttttcaatttactttgcccagatccatcagaggaatcactattgatggcagctataaccttacaaaatatatttcttaaataataagatctgaaagtcaaaattactccctgatccatgggctacagaatggatgttgtgttagcaggcatgaaaacaacattcatctccttgtatatttccaatcagagctcttgcatcacggtacattgtcaatgaacagtaatattttgaaaggaatctttttttctgagcagatctcgacaatgatcttaaaatattcagagtagatttagcatttagtaggaagagtagatttagcataattctttcttttttttaattgagacagagtctcactctgtcagtgctggagtgcagtggcagtatctcagctcactgcaacctccacctcccaggttcaagcaattctcatgcctcagcctcctgagtatctgggattacaggcacgtgccaccacacctggctaatttttgtatttttagtagagaaagcgttttatcatgttggccaggctggtcttgaactcctgaactcaggtgatccttccacctcagccttccaaagtgctggaatttagcataattcttaaggaccctatgattttttggaatggtaagtaagcattggcttcaacttaaaatcacaagtgcattagcccttaacaagagaatcaacccaatctgtaaaactctgaagccagtcattgacttctctctagctaggaaagtcccaaatgtcttcttcttctgatataaggctgcttaatctacaatgaaaatatgttgtttatactggcccctttcatcaattatatgagctagatcttctagttaacttgcagcttccacatcagcacttgctgcttcaccttgtacttttatgttatggagacagctcctttccttaaatctcatgaaccaacctcttctagcttcaaactttccttctgcagctttcttacctctctcagctttcacagaatggaagagggttagggcattgctctggattaggctttgatttaagggaatgttgcggctggtttgttctctccaaaccattaaaactttctccgtattgcagtaaggttgttttgccttcttataattagtgtgttcattggtgtagcacttttaatttctttcaaggagttttcctttgcattcacaacttggttaactatttggcgaaagagacctagctttcagcctatcttggcttacaacatgccttcctcaataagcttaatcattttcagtttttgatttaaagtgagagacatgtaaaccctgcattcagttgaacacttagaggtcattgcaggattattaattgacctaatttcaatattgttgtgtctcagggaataggaaggtcccaggagagggagacagacagggaaacaattggccagtggcataatcagaacacacacaacattgattaggtttgctgtcttctatgggtgcaggtcatggtgccccaaaacaattaaaatagtaagatcaaagatcactaaccacagatcaccataacagatataataataaagtgtaaaatattgtgagaattgccaaaatgtgacagagagacacgaagtgaacacatgctgttggaaaaatggtgttgatagattagctcaaccatcaattaataaaaaacacattttctgtgaagcacatagggaggccaataaaatgagggatgcctgtatgtagcttctggaataaatctctaatcctggaaaagacaatcaaaatacagataatacataattaattaatctttttagctttagtgtcctttgttaatgaatttcctattttacagatgagaaggtaaatgatatgaagataatacactaaaatggtaaaactagaattctatccccagtcacgttacttgaaagtacagtagtatttctattatgcttgcctgtctcctataactttattttgctaaagttatttttgatatttcataatattgaagccctttcatcaaatcaataaagcaaaacaaaacagaaaactctacatcagtggatccatttgtcctcaggcctttattcaccctatactgatccatcagagcaactggctgaatgcccagcctttgggcagcattcaccaaatattttttggaaaaaaaaaaaagaacaaatgaaagaaaaaaatcagttgcatttatacacatgggaatcttccacctagggtttttcatcttcttttctttctttctttctttctttctctctctctctctcttccttccttccttccttccttccttccttccttccttccttcctttctttctttctttctttcttttttttttttttttttttttttttgagacagagtctcactctgttgcccaggctggagtgcagtggtgcgatagcagctcattgcaacctccacctcctgggttcaagcaattctcctgcctcagcctcccgagtagctgggactacaggcgtgcgccaccatgcccaactaatctttgtatttttagtagagatggggtttcactatgttggccaggttggtctcaaactcctgacctcaggtgatccacccaccttggcctcccagagtgctaggatcacaggcatgagccaccacgcctggcctcattttctttttggcttgagaatgcaaacaaggagttctgcacccacacatggcttcaccatggagctttctgagacactgtaaagcaacaccatagcaaggtatctacatgtaaaacagtatgagatgcttcatgccaagaaaaagcaggacaaatacagaattaaaaattgtctgagggagcttccatacaaagaattcaagcataactaccagatttggggatcattttgtgaacacacgcctgatgaacagagcatggtgtttcaatgaaacaggtatttctttgattaggtcagtggtagagggaaagatgagttaggaaataatacccgaataaaacacagaaatggtgtttgtagaaatgacaggttaggaaagcatcatgcccttgtgccataacatcttgacatgactccagtccaaaataatagtttaagagttgaattagtacccaattacatttaggagactctgggaattcacgcttgagtaatgagagaagatagtttgtatgtaggtctgctaagttggaaatagctttttggaaagcctgttctggtatcccagagtgagaagttcctggcatatctgaacagggctggcagtcatttctttacacatatcagcatgcttttcagcaaactacctctgagatactttcatgagacaggagcagatggggtgccactgacaccaaaaggggcagaccactagtgtgacttcttggttaaagccagggcagaagggttcagcggtgctgagctgcactgagcatcatgctgcatgttttggctaactgaggcacaggaaatttcactgtatcacggttccttatttcatcaaatacatcatagaagcatacaacatttcagtgaaaagtcagtcagcttcagctgtgtttaccctaaaaactgacctcctcttgcttcagtgagggggctttgcttatgtgatgtccaaaatagactccagagacagtgctaacaatagttcatcttatggccttcatctgatgaccatgcagtattctgtaccatacgacccctcctttagaaattactccatgtttctgtgtccttttgtcttgggcacataaataaagcaactcccactcacagttgaccacatcaccatttgctgctcagtgaaaaaacccagggagttcagagaacctttgtctgcagaagtggaagggacaatctgcctgagggctaacccgatgtcagacatgctagctcgatgagcaggcttgtctatatctgactgcaggtgacttctctcagcctgcccacgggatctttctccacttggacacccaaatgaaaagcccatccattgaagattctttttaaaacaagagagccttttaaaaatacattaaaaaatagaagtaggccaggcacgatggctcatgcctgtaatcccagcgcttttggaggccaaggcaggtgggttacttaagctcaggagttcaagactagcctgggcaacataatgaaaccccagctttacaacaaattaaaaacaaaaacaaaaacagctggacatggtggtgcattcctgcagtcctagctactaagggggctgaggtaagaggatcacttgggcccagggaggtcaaggttgcagtgagtcatgatcacgccactgcactccagtctgggcaacagagtaagagcctgtctcaaaaaaacacaaaaatcgaaaacaaacaaaaataaaagtaatacatgaacattatataatgtaatgataaacactaacaaaattttaagaatacatcatctagagctaatgttgatattaactttacagttttttgttgttttatatataaatttacatattttagaccatatgtatacatatacataaaataagtaggtatatatactgcttttacaaaatgagatttttttctcacttggtatattatgaatatcttttaaaatcattaaatcacgtgtgtgtgtatgtacatgtgaaaattcacagaatcaaatattagagctagaaatgatgtaagcgatcatctgttccagcgtttctcaaacttttgactacacttaaactaaaaaataaattttacattgcactccagtacacacatttatattaatcatacacactcaaacacacacagtttcatataacaatacttactcttaccatgtaagaaatactttaatttccattttactttgatttctttaatgttggtaaagctcttctgcaaattcataactcactactgagttgtgatcccagtttttgaaaaacaaattcaataaaccccttcttttaaaaggaaaacatgctcagagacattaagtgatttcccaagatcacaaagtgaataaatagcattgtcaaaaccagaaacagatctacttgttttcagcccatgccatctctatctcctagcctcactgaatcactaattattggtagagaggtgtgcacatgtgtcagtgtgtgtttgtggtggtaatggcaccccaaaatatatagcatccccaaatataaagaaaaatgctcaacattttccatgagaaaaataaattaatgtaatagctgttttatgatccatgagttaattttctcacaccacactgctttacaatattgtaaggcagcaggtccagcaatttcttcaaatgaataaagatcaaactattaaagacacaagtcactagtttgaataactttgtattacaaaactgtagaatatgtaaaattatcactctatgagttggataaatatattgaatttatgaccttcaattgctttccttatctataaaatggaaatgactgccctagacgcctgaaagaatatagggcataactccaacaacaacaacaaaacaaaacaaacacaacaacaacaacaaaaaacaaacaactttaattcttgtttcgcccattccagtattttcagattgtgatctgggggcatgaacaatacctttttaaaaggttaagcacctatttataattgatctgacctctatcaaccaatgaagcagcctgtcatgcagttgtaatattttatgtccacagaggccccaaagtatattgcaatcatatacggaaactacactctgttgagcagggtatttttagcacagttctcaaagcatcgctgagctggaagaatttgaggcagtaaagttagccactatcttcattctgcccattaagtaagatcggctggatcctaaaatgaagtgacacccattatcagaggcaaagcaaatttcctcaagagaccaatgtgcccttcaggatattagctgctggccttcgcatttagaattagttaaacaaatgcagtatgtagttcagttaactgaccaaatcatttatattgtagtagtacaaaatacaaaatctctccttctaaatacgataaaaataaacatttctctaacacacagctcaaatttctcaaacaacatatactccatctggagtttaaagtcacgattagaagattctatgtgtatcacatgtgtgtgcacatgtgtgtatggttttaaaaagaaagcatatatttactcataatggtatggtagaactaagtactgcttcaaatttttcagtttcctgtaataggataacagctctgtacccataccatgtaacttcacaatgcctcgcagtggaataggtgggggcaaatatccctgccttgttgactttggccagtggattctggcataagtgacagaaagacagttctgaggtgaggtcttaaaaggcatcacatgcttctgctcagtcctcttgctcttgggccagcagccagtggaggaatatgaactgggtagctgctggttgcagaaagagagacccatggagcagagtgaaacccaacctgcatctgaagcaaagctgccccagtcatcccacagacccagagatgagaaaaacaaatggaggctgttgtaagtgctgagattttggggttgtctgttatgctgcattaatggaacaaacctaactgacacaaaagggaaaaatgcagaattagaatatttttattttactttttttcaatgccactgaaaattcttcattctttaaacacatagccttttgaaagaaggtagaaaaagactagaaatgccatggaaattaaggatggtagacctatgaggatctattaacataagatacactgtaggagctaaaatagatgaaatgggcatagaaatatgcatataagttcagaggagctgctgctattccagccttctgttggaaaaattctacattgagaaaggttttaatttgcccaagagcatgggcaagaaataatttcaatatttttacagtgctatccttgatgatgttcatcttgacctaagtccttgaattcaaaaatgttaattaaagtttgtaagtgttgatagaattttataaaaaagaccagatgctagaaagacaaaaaccccacaacagacacattgccaaagataaaagatccaccttgagggctttcatgttacaaaaatgaaatggagaaagataattcagattttaatgtagctcatattctacaatctatacaaatttccttatgttactttttaggattaggtttggctataagtgacagattatccaaattaatggtggcttaaacacagtaggatttcttgtctcttataaaatatgagtccagatctcaaaatttagaggcaataaatgcagggctgcaacggctcatcacaatgccacaggcccaggatctttcaatgttgttgctccacaattctcagcacacagtcacccctgctgccaaactctaagatggcctcctgacatccagccatcacacccgtattcagggggcagaatagaggaaacaataaagaagaacacgccctttctctggaagggcacttcccagacatctcatgtgatattttagtttatgcctttattggccagaacttaggttcacaggtacttttaaaccattatactcagaaaagaaactgagaattattttatcaaagaaggaatgaatggatacagggcaccagtagcctctgccacaattcttactatgttgagagtgtaacctataggcaagcagtaagcctataggttatagtctcacagcctgctctaagtcattgtggtacaccaagacaagaactttacagaaacagaaaaatagcatttcattttgagatctaaacaaaacactaacaacactaacccacagaatcgcagcatacataaaactaaggtgatgtctataaatccctcactccccttcctcccttcctttctttattggtattggttaaaatagaaagtctagtaatcactaaaatgatcccaaacatccaatcactcaaataaaaaaggagctgtgggttaactaggttaaggatacattcttcagacaaaatacgttaattttttttttttttttaaagagatgggttctcactatgtttcccaggctagacttaaactcctagactcaagtgatcttcccaccttggcctccagggtagctgggactatagatgtgcaccactgagcctaactaaaacatgctagtcttgactgctagcattaaaggcctaaatttgatggaaaaggcacatattatctgttactttctggtatttaattttaggtttttggctagtattaagaaaaaccatactgacattaatatatgcagttttattccaaataaaatatgtgacttatttgtaatgaaaatataaaggcaaatagtgagcataataaatacatatgtgccaggcaccatgttatgcacttaacattacatatttcacttaactcctttttcaaaagtaaatctagaaggaaggactattatatcttccaatttacagaatagagacttgaatgggtaagtaatttgttcatggtcgcatgctactcaatgatggaaggtaaaaccaggatacatatttttttttgagacggagtcttgctctgttgcccaggctggagtgcagtggtgcgatctcggcttacttcaagctctgcctcctgggttcatgccattctcctgcctcagcctccccagtagctgggacctcaggtgcccgccaccacgcccagctaattttttgtattttttagtagagacggggtttccccgtgttagccagcatggtctcgatctcctgacctcgtaatccacccacctcggcctcccaaagtgctgggattacaagagtgagccaccgcacccagccccagaatacatacttaagcctctctgactataagactcaagcttaatcactgctttactatagcatatatcttaaggaaaattgtatgcatcatagcgataactagaaaattacatatttgtctttatttttataattcttccttgtcttatcttctatttaagtgaatattcagaaaactctgtctccaatgcttcgcaaaaccagcatacagcagactgactcatatataatagccacttgatagctgtaaaatgactgaactatgaaattattacacctattagtagttctattttaatctactttccaataaatttatgccatactaatggtttttattttaccgtaaaatttaaaaagcacaaacatttcctagcgtcataaacagctccaccactctgaatttctactataaaatagtatctatcactaatggctagtagtggttttagaatcctgcaaattgtttcataaatagctataattgcaaatgtcttaatatttgaattgtgtgtatgtagcttacttaaaaattctaggagcaggaacaatggttgaaaaatgcatcatttattgcttaagtttatatttacaatttctgttactaaagatccatagcaatctcctgagtttacaagaattataattatctgtccaaaaaagctcaaatttcaaaaatatatgtgaaatatacatccttttcttaaaggtaagttacccacagaagatataaattgttaacctaaaatatacttgctcttaagtacaagcccaaagcctaaatggatactagtccaaaaataagataccaagagggtcatctacaaaaaaaaaaaaaaaaaaaactcatacatggtatttcccatgcccagtgtgctggggagaaggtgacggaccacagtactgaactgttatgcaggaaaagtacttaattcaaatttgaaaaaaaaatgtatattacctttctctctctctttttatgtgcctttggctgccctgtcactttaatgcctgaaactttaatggcattctatcaatagaatattctgtattcttgggaagaaaagacactaagcaagtgtggaaagcataattattaaccttaaaataaaagctgtttttatcattgttggttaaataacaaagggagactataagcctactcttctggctttggagtcatacagcccatgaagttttctagacacacacatttattcttagagagatctcattagatattttctctgcctgtggatttcattattttaaggaggattactggattgctaaagaagaaagaaataggtttcacggattcaaacaaaacagaatgaaataaaaaagaaaagaagtctttgttataagtaccattaaaagagattaaagatgaaaaccacttttggactatcattaagctggtattataacacattgggctgagaagagatattaaattgtgtcataaaatgatttttgacatttgactttttacatgtcttacatttagttttagggactgtgggatgaaggtgctataaccacataagatcactgtgcaatgttttggataagagcatttactgttaagtaagatgttatccagttgtccaatgagacctgtttataaccttttatacaatatctgccttatttaatcattgaaactataaataaacatggtgggaaaatgactacttgttacctgaaaatctatctgactgcacaaacattactagagcactacttggtgtcaaatactatggtagacaagaaaagaattaggtcataataaagaaattttaaaactatgggagatgtgcaacaatgtgaaggtgcttaatgccactgaactgtatactaaaagtggttaaaatggtaaattttatgttatgtatatttaatcacaattttaagaaatcttgagagaattcttcatggcagagtaaattaagtggactatggcaggctaacaatagaggcagggcctatttgtattgacacataaaatatgttgaggatatggcttttaaattttcaaatgtatttgtagtagattttagatttataagaaacttgtgttaattcaaaaaattgagaaatgcaatgttgatgaaattcattcttctaagttggtacccaaagccttgtatccaaatgcctctatatcaaatacaattgacccttgaataacacgggtttgaactgtgtgggtccacttatatgtagatttttttttcactaaaagttacacctgctcctcttgcctccccttccaccttctctacctcttctgtctctgcaacttctgaaacagcaagaccaatccctcttgttccttctcctactcagcctactcaacataaagatgataagcataaagacctttctaggctaggtatggtggctcacacctgtaatcccagtactttgagggggctgaagccagagtatcacttaaggacaggagttcaagaccagcctgagcaacatagtgagaccctgtttctaaaaaacagttacaaaattggctaagcatgttggtgcacacctgtagtcccagttacttgggaggcggaggtgggaggatcatttgagcctggaaagttgaggctgcagtgagctgtgattgtgttacttcactccagactgggcgacaccgtctcaaaacaaacaaacaaacaaaaaaaaaacaaaagaatgaagacctttttgatgacactcttccacttaatgaaaaggaaatacattttctcttgcttataattttcttaacactttttctctagcttactttattacaagaatatagtatataatacatataaaatatgtatcaactgactattgatgttatcagtaaggcttctggtcaacagtaggctattagcagttaagtttttagggaatcaaaagttatatgcagattttctgactatgcaagaggtcagtgcccctaatccccactttgttcaatgattatttgcaatgtaaaacactaaagtaacatgaaaaggatacttaaataacagaagatttgacaattcagaaaagtcattaaggattgtgctaggcccaaattttatcataataaagagtaattttgttatcaacaggaaaataatcgcagctttaagatgactttctatgttttttaaaaagggatgggttcttgctgtgttgcccaggttggactcaaactcctgggctcaagtgatcctcccaccttagcctcctgagaagcatccttgtagccaccatgccagaatctaattatttatatgctgaataaataagtatttactgtgggaaaataacaacgtggagagagggggttctgctgcttatacttgtttttatacattgttggttgtggtaaagactgctaattggtgaactaacatcccttttctttttttctaatatggaacactgatttttcagagtgatggcaatatactcaagccaataaactatacattttctacatgactaagtcatggctaataagatatgagtggatgtttctggatgggacttctgaggaaagtgccttaaagcagagggctgatgtagctgggatgtaactctttcctttgcccttcttcctccatggaacttggatgagatggctacagctcaggcagccatcttggggcctgaggtaacaaccacatgttaaggatgtccaagcaggaaaaatggaaggctcctgggtcccactggtgactgtagcatcactacacgtgggccaccaacctgtaaaattctcatcacagatgaaaaataatcaactaaatttttaaagccactatttttaggtctttatatctagcagctgtgtacaatatctaacccatccatcagtaaaataggaataaaatggatatgacatcccactgaagtaagacagccttcttcaaattttaaccaaaacatcctgtaggattttaacctcactgcataacacatgacagttttatttcaagggaaatcaaaggagagaggagctcctttcatgacatttcagaggtaagtgtgctaaagctgtggcactatcaccacagggcattattctaaacatggatgcttattgcttttttcaggagagaggtggttttctacgtacgctgcaactaggagaggcaaaaaggaaatgtggggcccacacagcaaaagcagcaggaatcaaagttgcttgctttgtaaatcctgagatcggaatgctacgtatgttaggctctcagaggtctagtttaataaaattcctattttaattacagcagcatccttaaagtgctatcattaaggttgtgtcagcaattacttttttacaaccttattttccagagaataataaaaatgtgtttggcactgatacctagggctgaaagctggcactcagctctccaactatgcgcttttccttgcttctgacaaattggaagagaacctgtactgtgcttccttgaaactgtgaaaattctaaatgatcagacctccaaattgctttgcctttgattgtctgaaattcaggtctatgaactgtcaggggcgatcactgctgtcatgtttcaggatgagaaatgtggtttctacagtaacaacagctcagattgattagggcttaaaaattaaaatcacccctctgaactgtactttaaagaaggaaacaagagtcaaaatacagaggtattcattttcttagtatacagatctatgatggaatgatttgtgaggaacaagatattttaagatattttaaaataaacaagatattttaaaaagggaaagaattagatcagtgtgggaagataacttcagaaacagataacttccctccatagatggacaggaataaacatttgttttgtgaatggtaggaagagtgttataaaaatgcagcaaaaaaggcagcattaggaaattcattcttaaaaagaaacatcgctagactaattgaggcttaaagaagagtggaatctcttataaaagtgattttatattaaaggctgcatattatgtcaagcctcaattatggtaataatattaagtctacgtaatataataactcaaatttattgagcatgaagtgtggacaggtcttttgataatatttttacatgtatgaactcatttaacatgaatgacaatcctgtgaggtgggtacttctatgatgtccttgcacagtttctccagtagaaactgggacaaagaaatgctcaaatgcttgtcctcacagcagtgatgggaagcaaaaagtggagtccctgttgttcttctcaataggatttataggagcgtgattgttctggattgtgtgcaaatctatggaatagtaagttttattataacagacttccatggttctatgaaaggatgagtgggttttaagatactcatagagaaagtaaaaatatgcttataatgtcgaagtaaataataagaattttctgaggcataggaaaaagactgcaagataaagagtaattctggagtaaagaaaagttataggaacaaagtcactaaaagagactgtgaagtcaataataaacacgctcactagcccagtgacagcggtggcaggggaatccaagagcataacaatctcacagtctggacataaatttctgactcacttcttactgcctggagtcattctaagacggctttatgacaaaagggaaaatctgattaaacttggtaggaagataaaaaagtttaagtggcagcaggaggggaaaaaaagaaatggaggtgacaagagaggagaaaacctgagaacaaaggtgacaggaaggggagagtaaggtgtcaggggaaagagaccatcaagaagtagtctgagaaaataggccaaataagcagggcaatcgatcataagtggcgggacttccagatgcaaaagctgccattacgaagacaaatctctccataatcccaggtcttaatcattttcagcctgactctatcccaaagacaatatgcctcagcattaaactgtatttacaggcactccctccactcccccatgactagtgggcaaagatggcccttgggatatcatgcagctgaatgagaagagggatcttgagacacatatgagatgtggcacccaggagaagaagagaaggtgaacataaacagttcacccttaaacaatgctgaggggttggggagggctgacccctgcacagtcaaaaatctgtgtatagcttttgactcccaccaaacttcactaagagcttactgttgaccagaaggctttctgataacataaacagtcaattattatatttttcttcagagacagggtcttgctctgttgcctaggctggaatacagtggcaccatcatagcacaccaatcatagctcactgtaacctccaactcctgggctccagcaatcctcttacctcaacctcccaagttgttaggattacaggtgtgcaccaccgtgcctggctaattttttttttttttttttttttttttttttttttttttttttttttaggatacagggtcttgctatgttttctaggttggtctcaaactctgcaattaacatatttttgtataagtattatatactgtattcttaaagctagaaagaaaatcataaggaagagaaaatagatttacttttcattgagtagaagtgggtcatcataagggtcttcatcctccttgtctttatgttcagtaggctgaggagcaggaggaaaagaaggggttgatgttgctatctcaggggtggcagaggtggaagaaaatctgcacactagtgaacccatgcaattcaagggtcaactatattttaaatgtttaaattgatattcatctgctactaaaagtccctgaaaaaaagttatatgaaaaatttaaaaagatatttggaaagaatttcactaggtagataaattgataccataaagatacattggaactagacaagatccactatgacattttctggaaaagtagtctgcaaattgaatatacatcagtgcttgctttgatatacagtttgcaagtcatttttttttttttttttgaaattgtgttaaaacccttacattctaacattccctgggctctgcagactgacaactattcatcagggattttcaggtacagctgcgaagcggcaaaaaatactaatgttagaagagctggccacgatcatgtgtgcatctgggtgggttgaataaattatggggctaaacaagggtcagtttccttcccttggatacaggggttactatgtcattcccctcagttgcataagatgcttgtttgcttaggttgcagttcactgtgactgactcgtttttttctttctaggttctgcaaattgtcctctgtttcacctctagtgatttccaggctaccctctatctctttctccttttttcaaatttgagatggagtctcactctgtcacctaggctggagtgcagtggcgcgatctcagctcattgcaacctccgcctcccaggttcaagaaattctgctgcctcaacctcctgagtagctggaattacaggcgtgtgccaccatacccagataatttttgtatttttaatagagaaggagcttcaccatgttggtcaggctggtcttgaactcctgacctcatgatccatctgccttggcctcccaaagtgctaggattacaggcatgagctcacctcagaaagtcatctcattactccttatctctccagcatttccagcataatttctatcttcctcttcctcgaactcagtatctctttgacaatatttttaaaagttagcaatattgccacatcacttcactgtatcttgcactcatttttttttactcttttattttgcccattctttccacaaatatttaatcattgcccaccaggtgccaggtgttatgttcgacatccaggataccacaaggaataaggcagaccgatgttatgcccacgtgaatttgaagttctaattaagaaggcagacattagacaggtgattgcctaatacagttgtgatcacgcactgaaaagagaaagggcaggctgcaaagagagcatactaatgggagctgaccagatgaaaggaatcaaggaaggattcacgtgggaaggagggcagacagaagggggttgaggggaattcacttctggtgcctgggaccccctggctggaaggcctgggggcagagagaagcacaggtgttgaaggactgggaagaagtgcagagatgggctgagagaaggcacagcaggaggagagctggcaaggcaggcagaggtaagaacatgggagcctggcaagtgatgtcatagatttctctttttcttttttttttctttttttttgagacagagtctccctctgtggcccaggctggagtgcagtggctctatctaggctcactgcaagctccgcctctcgggttcacaccattctcctgcctcagcctcccaagtagctgggaccacaggtacccgccaccacgcccgactaattttttgtatttttttagtagagacagggtttcaccatgttagccaagatggtctcgatctcctgaccttgtgatctgcctgcctcggcctcccaaagtgctaggatcacaggcatgaaccaccacgcccacccacttatttcattttttttaattgcaagaaacatatgaaaccatcagaggatttcaagcaggaaaaagaggtaaggcccattgttggttttgagagattgttcctgtgatgtgaagaagatgggtcagaaggagcaaaaggggacacagggagatgagctcaaggccccagtgatagtccaggggacagttgatgggggcttacattagcatgccagctgtgagaaggaatggaaatgggtgggcataagagagttaagtatggagaataaaggcgactcataaatgcccttgatatcctcctagtgcaatgacatgaaggtgtatatctgtttccagaatggaagctgacttttctacgttgcctctccactcatgccagaagccatcctacccaattcctcctttacatactcagggttcttctgtccttcactttgttcagaggttccccaggaactttgatccttgacttggagagccttatatatttgttcatagattaacatgattaataagtcagtacattctccagtgaccacaaacaccgggtctataatgtgctctggtcacgataaaattctgggctaaaaagtcatcaaagaagtaccttgtctactgtaactcatgccaacaggacaactaagagattagataataatcattatgattaacacctactgagtacttatgaatataccaggttttctagtttgatgatgaatgtaaacctcacagaactcttatgtcctataatttatctcaattttacagaagaaaagactgaggcttagaaggccaaagtaatttgcacaaagaatgtatggtggagccagcagtcttactctgcaactgactgacttatttgataaggtaatacacatctcacaagcagaagctttatcttctatgaaggaatctttggctccaagccccatgcaccagttaaaggcattgctgagatatcccacagtctcagtgatagccatatttgtcaaactgattattgagattctgattcccttagtgaggggagcatttaatagtcctccatggtgcgggggcagggaagtgacaggagagggagagcatcaggataaatagctaatgcatgctgggcataacacctaggtgatgggttgatgggtgcagcaaaccaccatggcacacatttacctatgaaacaaacctgcacatcctgcacatgtatcccagaacctaaaataaaataaaaaaaaaaaaaccagtcctccatccagtcccctctttctaacctgaaacccagcctcctttcatgttctgagaataaggaataatactgaataaggaaaaatcagcatcatgccaaacttcctataagtctgttgaggctcagtcctcaatagtagtctctacccatcttcctcactcatgaattctaggaaatggattaggaagctgagtctgtccccaagtctgcagcccagcagcctcaagactgagatcctccccttgtcagctctcccctgtgaccctgagtcctgccatttttatccaagctcttctgacagatgcccttaatgtgaactaaggagagcctcagatagagctgtgccaagaaacctggtgactgggtgtggtctggcaatcagatgtccttgttgctatgccatgtctgttagatcactgatgatgaatatacatcttgcaaaaatcaccgatttttcattctgtctggccttcctagccccacttttaccctagatggaaaagatctaatttcaggtttgccttcctcagctggatctggccatctgaatttaactggaccatcctcacccctgtccgtgcctatgagtcataagtgatacaaatgtcagcatcagcatcagtgtacagttcttgacttcaacaaaggatgttaagactgcagtcactccggtttttctcctagaatctgaactgtggccagaaataatttctggctcctggcccatggcatagatggtttgaaacctgagttctaacgccaaaagtgcttttaactcattaaagatgttggaaaaaccacttagccttctgttgattcatcccattagaagaatacaagccaaactatagggaggtaaatgaagactgtatttagaatcaaacttacatctataagagcagttaatatttatggagcactaatgtgccagacactgtgctagatgccttggataattatctcatgcaatcctcacaacaactcatgaatatataatgagattatttaaacgttatatttgagaaaaattaggcttggagagataaaaaaaaaaactaagattaaagagctaggacatgctggaagcaggagccaaccaaagtcctctttctcaaccctgggtggaggagttcatattctctctcagcatagccagatgcatatgtgatatgggcacatatgctttcaatgtatgcacatttaattttcaaagctagaaattcaattaaagaaaaaaaatgtccaatttgaccaaggctccttgaaacgggcttggttgtgaagaatgatgctcagaaaaacagctcccctttctctaacaattgttcccagctctctttcatagaagatgcaacatctactcctactaatacaaataaaagagaattattctgaagcaatttcttctcctaagtgctttttgtataggatatctatccataatcaacatttgatagcagttcttactttttaaaaaagtacttaaaaaccctttatttcaaagggattgtctgtagggcttgtccatgaaaataattctccaattatgctatacattctctttactcatctccacctcctacattaaaaataaactttccaaaacagataaaacaactacctaaaaagaaattaaccaactcagagggaaaatgtggggataaagtaagatcggcattcagaaagttaacttgtcgcagagataaaagatagtcccaccaacagggtatggggctaggccagcactatccagtagaaatattatgtgtgtcacatatgtaattttaaattttctgtagtcacatgtaagcaaatataaaaaaatgtgaaattaattttaataatatttatttaatgccaaaaatttcccatttcaacatgtaatcaatctaaacgttattaaggtttcatattggggggttgctaagatttggaatctggtatgtattctgtacttacagcacatctcaatttggactagctacatttcaaatgctctatagccagccacatgcagctagtggctatggtattatcagataggacagactagaccatcactaatctgtgaatattcttcaagtttctaaacataatggcttcccatctttagaaaacagccagctttttccttatgcttttctttgccaagcactgtttcttttcattgcttcccaacctctctaccaattcttcactcaactcatactaaagaaaacaattttctgtcaacagctcacaatactaaagtgtagaattatacaccactgtacctttttcttctctgctttatacagtaactaggttatttccctgctctagtattactttattttcatacctcttgcctttgatttatgagggctgccagtttctctgaggtttagtactgaaaactccataaagtttcctctctgagaggtctggtgtttctttctgacattaactgtgctgttatatttgcatttttactggaagccacctcaactcatctttctttcaaagaagttgggatattttgttacaaatgaactagtaataaaatagtttccttaggaaaacggagagaaactgataccaaacagaaatatttgcttgtaatcttcaaggaaccagtataaattgctacacgcagctatgccacccacaagggcatcctgacaagactaccagcacctcaagaagtagaatggattactacaggaaggtgattataaagtcaagtaaaaacaacaacagcacttccaggatcatcttgaagaaaggttaattggaaaggaagtgataaacagatttacactatttggataagaaggatctatggctatttctggtgtatcataatacactcatttactcagaaaaatgttaaaaaaaaaagtgcattgcaaagttgtttcaagtgagagatagaacaggaaatagaaaacaacatttgaggaagtggctgctccttccctagatgatcatataaaatggcaagctgagagaagaaaagggcaaatgagacatgatgaggtaataaaaaatagagaatgtcagtcaaatttattatctatttttgacaattaaaaccagtagttaattgtaggcagttaatgactagcaaaagtaggaggaaaaatagtcaatgtaagaattaaattcttattgaaaaaaagaacagtacatacctctctgtcataagaacaggtagcatttagaaaatgaaacttttcaatgtaccacagaaacagcagcctttcctgattggaagagatgtctacttcttaagacaaacaagcagccgtccaaaacccatggtagcaataatagacatgaaaaataaataaagaagagaaccattctccagctagaatgcaaggactgcatttactcacctaacatctaccccagggattagatggcatgcaacaggtactcattaaatatttgttgaaaatatttttggggaatgattatagctgtaggttactagtaggtatagttgtattcccaaatatgttggggtagaaacaatgctgagaaccactgggcgagtggcaacctcccccaaagtggaaggattaagtctgggtggtagcaggagtcttgctattatccaagctggtggagtgaccagggaaactttattatgaatcctaaacagagtaggggtcatgaggaggaaccctttcagaagccaaggtatgactgatccaattagatccgtggatcaagagccagggacctggaagaagtcaatatatcagccagaataaatagtgatcatactttccaagggacaagttgaatcaatgatgtccataacgtaaataggctttttttttgtgtgtgtgtgtgtggccatgcactcaacctttaccaggatcctgtcctggagtgtctaggatactgtgcaaatccccagattataagataacaaggaggaggaggaaagccaacattatccaataaagccagacaaagttaatagtgttaaaattggtgtgccggtaaattaatcaattttctattcaaaaacatcagttaccagtggattgccacaagggctacagctatggaaagactgaaatctttgtagaggacctttcctccattacatattcaagtgaaaggaggcaattttcattgacagtagcttctctaccttccactcaaaaatacagatcctatagctgtacagaattccttgtccttatctatgataatagtaatttctttttcaggttccttcagtgcttttccattgcttcctgtgtcttaattaaaatattatcttcatactatgagcatgctctctagagagctacctagctctcattcttccaggtgctgccagtggaaagttaccaaagcaagtaacagagtaagttaataaacaagcaaatgagtacatacataaatacatgaaaatgaaagtaataaaacattgcctaaatctaatttaatttattatactgttttcccatcatgccacaccagtacatttatcttctattcctgaaaaaaaaaggttcattcctataaggataggctttctcttccctttcacgctttctctagtcattacattttttctgcaattattagcctgctctttttaggacactgtgcccgggagataataaacataatgccctatatgtcctacacagatatttttgatgagcttctggttcctctttctccatgaatcctcagctagattcctgctgcctggtctgtcttcctgggtttgggtcctacggtgcattctgaccgccaagatttgtttgaataatagttcctgattgtgaagcaatctgctctggactgctaaactcattgcagacctccagctacatgttaacctttcattgcctggttctcctagaggcctggcccatcagcccatatatctcctgtctttgcacattagcccagctactagtgcttcagtctcagtacctcattctctgtatacaacccagtgccgcccagcctttgacactacttaaaggttattttccttcatcctttgagtaactcatccatcataatttagttttatacacagaaatcttactcaattatattacagacagttctattaatactgctgacatttactaaatgtgtagtattgtatggctatgttatatatcacagcaagaaattaatgaatttggcttctggttttaacaatcattctggtcctataaaaggcaaacttaggagtatcgctttgcaggggccacttgaatttcagggacaaacattttacacgtcacctgatggccataactgaaaggattgcttcatcagataaggtccatagataacaagcaacacggagatttctatggctccctggtggtaaagctgccaaattacctcaataggatgtcagactccaacatatataaactagtcagtaaaaaggactgcagttttgcagaatcagcatttaggaatggtcagtaaaaccctgaagaaaatacacaaatgacttacagattattcatatagagaacagaaagacttcctatgtttgctcaagactatagatgaatcaaagctgaagaaagacaaggtacatagagtaaataaattagaacccacatagagtaaataataaggaaaaacaggctgattaataaatgtagtcattcattcaacatttattctatgcccactaggtcccaaatattgcacttggagttctaaacacaaagataagcaagacaatgtttttgttcttgagcagcttaccttccagtggataaagcaaatacacgcatgaaagactacaatagaagataaatgctgtaggagaattatgcaaagcacttcacagagcagagagaaatgaccaatttcacagagcaagtagaagtaaacttagaggaatatcataaaaaggataagacttgacatgcagaaggagagggatagggacatttcaaaatgtaagaaaaggtcagaaacaccaaaggaaagaggtaaagatagtacagcgtactaaaaaagaccttttagaagcagggcacagaggtgtcccagaagccatgacaggagagatgttcagtgatcagagtatagtctgtaaggtcagaagcggcaaagccaggtcactgaagtgcagggcccctctgttcagcaacacccaatcagagatgggtggtactttggctgctgtggaggatactgaaagcttcaaatttgaaaaggataagttggtgtgcttaaagttagttctcaaatatattagcttaggatatttcacaaaatgaacaccataggaaggaccagtgcaggcagaagacaatacaaattctgcattggcagaatttgctggctgccacatcgattgaatataaaaacagtgaaaagggaaggaaacatcagaaatcttgttgtttgaaaaataaaataaagctgctgaactgactgggagaacttagaagagaaatcaatctctataagaagagctaaaagaaaatttataaatgaaagaacatccaaagagccacttatttccataacttattcatggatacattgcatatttcatagcattgaagcctgaaaatgtgttcacagcccagcagcattggcatctcctggaagtttgttagaaatgcagaatcttaggtggcacttcagacctgttcattcagaatctgcagttcattaagagccctatatgaatcacatgcacattgacgtttgagaggcacctttttatagaattggggaaattgtgcatgctacaaaaagggcaagaaagctgttgttaaggcactaagtgggaacatgtctttctccacctttggtaccctcctgttgctctctactcgtgctggtctaccagatgccccctggaatgccttagaatacctgcattacccacagggtagctacttccctatgactgagcttaattaggtactaagaggaaaagaatatgattatctcattaaaataagatctcaggtactaaggtgtgaaaggttgattggattaacattcccagcaagcattgacattttaagggaatttgctaatccaaatggatttctaattgacagtttacaggaaagagttatttttcagctgggaaggcttccaggtatctattgtccctgcccactgcaggccactgctagcagaacaataaattgttagaatccatttatgggcaaaatagcattataataaattaagccacattcatctgagttatggcaataatggtgatgagaggttgagctgattagctaagattaagttacatattatgataaaaatagagcataaatagataaggacagttttggatttaggattagaaataccaaaagagcctatttagttggatgtagaaaagaagtgaactgagaaggaaatgaacatattaaacactctcaaataaaactagatctctagaaagaatataagggattaaaaaaactgagtaaataaaatttatatccagattccttggctgtataaactacttaaaaattgaaaactaagctaacaaaaaggatattaaataacttgactaataaccatagcactgctgcctacacaatccaagaggcaactgtgtacatgaaaagaatatctttcagcagaagcttctaaaatcaagcaagctacacatccttgacagagactcaaaatgtaagttacatctgctaaacatgaagtaaaagaagcatttctttccgtgccttctgattgggatgaaaaacataggtaaagcttaagagaaaaataaaatggattaaaaaggaattttatttcaggccaacagggaatggaaaatgggcacaatagcacacaaagtaagaaaagcttatttggggatgagggataagtctgtattcagatttgagcaaaggcatatacccagcaagagctaaagtatttgacctttctgaaactcaatctcttaatctacaaaatgggtttaataataccaacatttttttcccccagggttgtcttgtgaactctgtgaaatgtacagagtgtctggctcaataaaaataaaaataaatatttgatctttaactccaaagggaataaaagatgagttacataatacattgaatacaatcaactataattcacgtaatacggattcagagattataaggaaagaatacattatttatgcatatatataaatttacatatgtgtaaatgagattacaaatgtggatataaatatgtatttgtttattgtcagtgtgtgtgtgtgtgtgtatttttttttgagatggagtcttgctctgttgcccaggctggagtgtagtggcacaatctcggctcactgcaacctccaccttctgggtttaagcgattctcctgcctcagcctcccaagtatctgggactacagggcacaccatcatgtcggctaatttctgtatttttagtagagatggggtttcaccttgttggccaggctagtctgaaactcctgacctcaagtgatccgcccaccttggtctcccaaagtgctgggattgcatgcgtgagccaccatgcttggcctcagttacttatgtaagaattttagagtctgggtgcaaatcctggcatcaccatacatagttgtataatcttagaagtcatatttaactctctttagctcagtttcctgaattgtaaaataagggtaatagtaatccctaatctcacatggttcccatggtacttgttcttgccaggttgccttttaactttcagtaccagtgttagtggcatgtatctatcgtaagttccaactaaccccaagctgtactgagaacactgtatgtgtctagcagccttaggatgatgtggtttaaggatctagagagactttaaggtccaattctatatttgttgtgcaaacaattaaagctgctttccttcacagccctgattctacacatggtctacgatttcttggctgtgtggactttctatatggtctttttttctatttcattgagtctgaaaagattgagtttatcttttcagattcaatgttctaatttgtttgctgctaccatttttaaaccaattgtttaaataacagggataaaacatgcattctataaaacatttgtactatacctgagtgtatccatccctagaggtaaccattcttatatactttacatgtttaaatcccagacttctctatataaacaatagacagacagatcactacctaggcagggataatgcacagcagacacttaataaacatttgttgagtgcatgcattaatatgcaaactgtatcagagactgctagttgcccgcaagtatccattcttcccattctactcttcttttatagaacccctgattttagctaggtgtttttattattatgttttaattagtacatgtatatctccttcattagaatgtgaactactcacgaagaaaaaccgtttaatccaatctcattttcataattccaaggacaacatctaacaccaactgggcataaaggaaatgttgaatggatgacaccacttattgatccacctgtttttctgaattgtttactcagtgtaatttgggaaagagaccaactcaattctcaatggcccctaccttattcaccccagttaacttgccttttctcagctgtgtaccatgcaatggctcataagcaaacaatggctatgagcaaactgatgaggctatttctgttctctaaattaattttctgtaagtaatttgtatattttctgcagtgttttactgactcttcttaaacgttgattttgtaaaactgtaatccttttttctaaccggtatgcagtagttagacttcctgtggcggtaatttggcagttttgccacttgggaataagtggggatgacttcatttcccagcctcccctgcagcaactggatgtgagcagaattcacatatgcatcttccggatgaccccctccctactgccaccaccaacccttttacccatcctgctggccaaaatgcagatataatggtggtgaggcatcttggatgaagaaaattccccggagatgtcagagcagcagcatagaaggagcctggctccctgttatggtggactgcttgtgtccacatggatacagagagagaaataaatttctcttaatgccttgcctaatacaaaagcagattatttcatctcatagtcttctcatttctcaggctgaaaaccaagtaccacttgaggtaatctgtactgattctgctgcctccccaaagtcaaccccaacaaactggagacaaggcattccaatgtgtatatgtctacagtgtacaccataggatgtgttcacacatttttcttctctctaatgagcagagattatatcagcttactttcctttgcccaatactgtcataacaggaaaattccacctgtcaagcatttaggtttggggagaattctatgatatccatggcatgagtttaaaaaacaggctttattaggaaatttatacatgccaagggtcccttgatcctttcatcatcccacagagaagcatgctggggcagggtgctgctattgctgcagtttgagtctgagtttcagtgaagaaatcctcctcttttgtgtgtcccctttttataggtaaagcaggggaagcagttgtcagtgcttggtacctgagagcctcaatatagggtgccagctgtttatatgaattgtcagagaaagacaagcccctggctactttagtctacctgtcaaggggaggaggtcacaggtcctgtaggaaactgggcataggtataacctcacacactgggtgaaggaggcaacccattctcccctaccttgttccactggtttaatcccagaggcaacagggtcaatccaggtttgacactgtgcagctttaaggacagagagctgcattagaataacaactttgaataaatctgttacattagaggagtgccaaagtctctacagatcacaaagagaattccatcacacagatttaaatgatacattctaacagcaatagagtttcataaaataagcaaaagacctgtgaaataggggttaagtcaccaaatgacagatatcaaagagaatttaaaataaattatttacatgtgatcattaaaacagcataggcaatgaacagtaattcatctcctaaagtaataggaagattgatttaaaccaataaagactaaaatattctaaggttgctataactttattctttttcatgttcatatatttattatagtagcctacttttgggaggataacattcatttaaaaaaatttttttaagttaaaataaaagtagtgcccaagtgagaaattgagaaagaattgtaaatgcagcttgtggaactctgcagggttcttattttagaccctaaggtaagaacattagagtgaaagccccccaaagtactttacattccatcattgaacattgtatctccatcaactctaaatgtaatgaaaaggaaaaggagaacagaagaataaaatactaggaaaactaagacagatagaggagttcggtgagtagagaagctaagagggatgtggctcttaacggatgctcaaagtacaggcagaaaaggggtaaccagctattctctcttctcatattctgcattctgtacccacccaaacccaaaacctcttgcacacacttcagaaattaaaggtaaaaacattcaggattgtttctgccaaaagggtaaggtggagtccagggcatgatgactgaatgcttagtttatttcatttctaacctggttcaaaagccacctcctccatgaagccttctctttctgctggtgtgaacacctcaagggcaggagttaggtcttcttgatattcatgactggctcttaggcagatgctccataaatgggcattgaattaaataagaatatagatttagggtggtgctttcattaacctcaatgagaaacatttcatggtttgtttagctaaaataaatagatttaggtttgtgtcaaatttatctcgcttataaacttggcaaatctgcttttaagtttcacatataatctgaaagtgctgacaacatgtgtcacaagctaatgtctacattatgatccaatggtgggaagtgaaatctaaagtgacttacatcaccttgctgcaatttcaaataaaaacaaagcacaaagccataatgaatcactgtcaataaggtaagcatgccacaaatccaaggggccaatgtaacaggaatggagagagagaatactagattatcattctcactggcaggacctcaactgttccacaaatcattcatgaaaatgcttcttgtagagagaaaagatttgtccatattatgaaacgatatatttataacaacagtcataacaaagtataatgtaacagtttattattgttataagcttccatttaagacacagtggaggctctggttaggatcatagcttggaatgaatgaagtgcactggttggggtgtcaagcatttttatcaaatacctacatagtcctccagctgtgagtttcattaaccttctgttttcaaagatactaaattcacatgtatatttaaagtgttttctagtttgaagcataaaataacatttagttttatagtaaattaaaccaagtgcattctgatacagaactgaatagagtactcctcaaaatatcatattttccaaggacagtcatacattttgtttatttgcaattttaaatacctagagaacaaggacttgttctcactattatatccaacttacagccttatacatataggcaattgatatatgtgatttgatggcataatacagaggccccttagttgctggtcagtatgaactgaattatttagctacagtaccatgggccagagacattgcttacctacacctatttaaataaaagccatttctgtgaagctgttagtaaattatcacctggttaattaaacactggatacctttgtgcttcactgtctagggaaactgtagggaaatatataaagcattaatgtgacccttgacttcaagattataatcttactaaaaaaaataaggcttgagtttttaaaaattacattaccaaaatataatgcctcaaataatagaataaatataacatctatttcaaaaataaattttagccaagaaaataagacaacaatggagaactatagctcaaacgctagcggaaacttctcagtagggcatttaagatcttctataatccagccctgaactaactttgtagtggtatttctctttgactccccagcccctacccaccaatgctgtgtattctagccaaaatagaacattcctcccttcccaaactctttcatgctcttatatcctaggtatatggctatccgaccccatttctcaatgtaaaataatctcactagagcaaaattactagtatttactaacatctgtgttctcttctatttgggcatatggctaaaatatattttccaacctctcttgtacttagatgtggctacgtatatgaatcatagaaaataaaatgtgaatggaaggaatggggccactttttgacttccatctgtagaccacttattctaaggatctgggacatggtaaagtaacagtaggaagaatccaaggtccccaaatcattctgtggcacgcagtcaccttccaccactgctgacctgctttgagctgttgacctgtgacctaagtgaaaaataaatcacctatgatgttatgccactgagatttgggagtttctctgttgtagcagctagcattatttaccttaaccaatatcttcatttatcttttcatcatacatcaaggtttcctccactcaaagtctttccctctgccttaggcagaactaatcaccctcttcattttgttcccagagcatttattatgtatatttattattcattgctgtctgaatcagcttgtgagatccttgaaagcagatactattttatttaactttgaattcttaacgcctatcccatagcagacactcaatgaatgtttactgaaagtggttaaatgactgatagtatctgataaagctgcattaatctaatagaaagcttatatatgagtttgatttagaacacaacagaaaaagaaaagatttttcatggttggtgagaaaatgttactgttggatccagcaatgtattcaattcacacttgaatgtcatgcttaaacagcatttccttggataaacatggttcattttttccctctccttttaacacttagcagtgtgaatcatcaaatccagccacaataaatgcatctcctcttagttgccccttaggggttaagtgacaacctgctggtaaataattatgatctgttgtgattttccagagtagttttatttttccttttgacaaaggaatatagacgatggatgtatacatctggtattcattcaataataatctagccacaagtaactgaaaaaaggtctgctgaacaaatgttaaaactgaaaatctgcaaaggtttatagtctatgttatcaaaaattgaaacaaaacccatacatttccaaggtgtttgtaagtcttatgtgcccacttccctccaaaagctgcaacacacaccgcagcgtttcttggggattataggtggaatgaagcaagcacacgtgtacatccacacacatgcacacacaggatacaattagattaagttgcgggtttaaataacgagagagacaacatattctatctcctgcagcttctatgagccattctgactcctagcaagggcagagagccgtcactacactgtctgctcaaggtagggtctcacaggatctaaaagcacaattttttctaaaccactgccctttaacactcagagctgataccattattccagaagtaagactaacatggagttctcttgattctcaagccaaaatcagcctgaggaagtccccattttcatgtaggagaaatgaaaacgggaggatagaaagtaataagagggtagaaagcccagatgcctctaaaaataactgcatgccagcattttgggaagccaatttccctgagtctgcctgcttcattctgataccctttcatctagttggctatcatgaaattgatcagaaggcaatgatcaaaaatccatttcactacacacaaaactatgccaccctttaggaagaagcaaacgagtatgattttcacattttctaaaatgccattatatctttttgctagggaatactgatggatataacttcccaaacataatgattattctagtaaaacaaaagaaagtgggccaaaataaaacatcaggaaacctgtgatctttatcagaaaattttcctattaaaaaaattccagagtaggaattgagaacacattttgacagtggtgcctgctaatatttaaaacagtaaaaaggcaatgaaaaaacaagcctttaatatttttttagaaatgtgaaatctcttaaagctgctctctttcattgcattatgtgataaataactaactaggactcactttatttttccttccaaaggcaaagagggcaaagaatgtggcgaactattttacattcatgctctacatccagccaggtggtcaccatacagtggtttctaatatgaggcaccctaatatcaaagccttttacattgttaaaaaataacaaagaaaggtatagtagcaatgaattcattagcacaaaaaaggatagcagtgtgtatcagacaaaagtcttatgcacatcttcatactcccttggctatgcttcctcccacctggggaactaagtttccaccaccagcgtcacctgctctgggagtgttgaatgttctcttgaggctgtggctgggcagtgggacctctccgttacccagctgaagtttctggattctctggccactcacagatgtgggagctggcagtccacactacagctggagaggccaatgcaacctggaaatgtcagggaattcactccccaaggggtgaactctgccctatgagaatggggagagagcagggcagataaatgccctcacctctctttttcactgttgtggagtgtggttcttttctccagcctatccagtagagttccatgtggcaagtgggtgcagctgcatggccaatggctgtgtcccttgttggtcttgagaagcagtaaccagccctggaaccactgcttcctgttgctttacttcctcccttgcctccttcccccatccttttaaaaattatggtaaaaagcacataaatgttaccatcttaaccttatttaagtgtacagaccagcagtgttaagtatatttacattgttgggcaacagatctctagaactccttcatcttgcaaaactgaaaccccatgcccactgagcaccaaatccccatttcccctcccccagaccctggcagccaccagtctactttctgcttctatgagtttcactactttagacacctcacgtgagtgcaatcatatcatatttgtcttttggtgactctcttcccttttccttcatctcactggcctgaatttgtatatccccaatgaagcattggtatttcgatctttgcttcagggtagtctttagaaaattctggctgggacaccatgttctgtataactgagcattaactcattggcgcagtgaacctgtctcctgaaaatagatccttgacttggatattaaaactagtctaaaacttgtatcatgtaataatgtttcatgttataagaactctttttctgatgaacacctggttctcacttcatagagcctcagtaatggtgggaattaaggtggtaggagtgataatgaaggtggtagtggcagtgggtggtagaagaggcagttaactagcattaagctctttgagccaggcagcatgcatcatctcatttaatcctgcctgcaatgaggtaaatttccttattgccatatgattcatatcatcattaccagatgacaactgagaatgtcaaggttaatcaagaacttgtctgagaccacagagccaatgaatggcaaagctggggtttgaatctaagcccttctgccttcagagactgccactaaccatgtggtgctagataaccgccactatctcagtcaaatccatctaaaccctatgtgccagaaacttctttaatttttaaatttttgtgagtacagagtaggtgtatatatttatgggatacatggaatattttgataaaggcatatagggacatcattatcacatgagggtaaatgaggtatccattacttcaagcatttatcatttctttatgttacaaatgatctaattattcttttatttttaaatgtacaataaattattgttgacggttgtcaccctgttgtgctatcaaatactagatcttattcatgtatttaactatatttttgtgcccgttagccatccctcctctcttccctcccacactgcctctcccagcctctggtaaccacctcacgtgagttggattgttttcatttttagcacccacaaataagtgagaatatgtgaagtttgtctttctgtgtctggcttatttcacttaacataatgaccttcagttctatccatgttattgcaaataataagatctcattttttttgtctgtataagtcaattctgtgtaagtaccacatttcccttatccattcatctgctgatgaacaaaggttcatcagcaacaaaggttgcttccaaatcttggctactgtgaatagtgcttcaacacatataggagtattgcagatacttcctcgatatactaatttcctttcttttggtaatatacctagcagttggattgctggaccatatggtagctccatttttagttttttaagggacctccaaattgttctccatagtggttgtactaattcatattcccacaacagtgtacgaaggttcccttttctctacatcctcatcaacacttgttattgcctgtcttttggataaaagccattttaactggggtaagacgatatctcactgtagttttgatttgcatctctctgatgatcaatgatgttcagcacctttcaggaacttttctcattgctttacattcatctttttggttgttggtaaatccccaacacaattctatgaaatgaaaagcctcattgatgcataaaaaatcttattatttttacccaaataaatctaggaagaaaataaagatcccatatattttactataaaaataaaacagaaaaaattacaaaatctgtgaaaaaaacaacatatatttacacaatgtagctggtttagaaatatttttagaaagcaagatgtattagttcgttttcatgctggtgataaagacatacctgaaactgggaacaaaaagagatttaattggacttacagttccacttggctggggaggcctcagaattatggtgggaggtaaaaggcatttcttacatggcagcagcaagagaaaaatgaggaacaaacaaaagcagaagctcctgataaacccatcagatcttgtgagacttattcactatcacaagaatagcatgggaaagactggcccccgtgattcaattacccccacccccggttcttcctacaacacatgggaattctgggagacacaattcaagttgacatttgggtggggacacagccaaatcatatcattctgcccctagcccctccaaatctcatgtcctcacatttcaaaaccaatcatgctttcccaacagtcctccaaagtcttaactcatctcagcattaacccaaaagtccatagtccaaaatctcatctgagacaaggcaagtcccttctgcctatgagcctgcaaaatcaaaagcaagctagttatttccaagatacaatggaggtacaggtactgggtaaacacagccattccaaatgggagaaattggcccaaacaaaggggatacagggcccatgcaagtccaaaatccagcagggcagtcaaattttaaaggtacaaaatgatcgcctttgactccaggtctcacatccaggtcatgctaatgcaagaggcaggttcccatggtcttgggcagctctgctcctgtggcttttcgggtacagcctccctcctggctgctttcatgggctggcattgagtgtctgcagcttttccaggcacatggttcaagctgtcagtggatctatcgttctggggtctggaggacggtgtccctcttctcacagctctgcccccagtagggactctgtatgggtgctcccaccccagatttgcattctgcattgccctagtagaagttctccatgaaggctccgcccctgcagcaaacttttgcctgggcatccaggagtttctatacatcttctgaaatctaggcggaggttcccaaaactcaaattttgacttctgtgcacccacaggctcaacaccatgtggaagctgccaaggcttgggacttccatcctctgaagccacagcatgagttctacattggcccctttcacccatggctggagccacagggcaccaagtccctaggctgcacacagcatggcaaccctgggcccagccctcaaaaccactttttcctcgtgggcctctgggcctgtgatgggaggagctgccatgaaggtctctgacatggcctggagacatcttccccatggtcttggggattaacattaggctccttgctacttatgcaaatttctgcatccagcttgaatttctcctcaaaaaaatcagtttgtcttttctactgcatcatcaggctgcaaattttctgaactattatgctctgcttcccttttaaaatgaaatgcttttaacagcacccaagtcaccttttgaatgctttgctgcttagaagtttcttctgccagataccctaaatcatctctctcaagttcaaagttccacaaatctctagagcaggggcaaaatgccgctagtctctttgctaaaacataacaataaatcacctttgctccagttcccaacaacttcctcatctccacctgaaaccacctcagcttggaccttattgttcataatactatcaacattttttttttttttgagatggagtcttgctctgtcgcccaggctgcagtgcaatggtgcaatctcggctcactgcaagctccgccttccgggttcacgccattctcctgcctcagcctccagagtagctgggactaaaggcacccaccaccatgcctggctaagtttttgtgtttttagtagagatggggtttcactgtgttagccaggatggtctcgatctcctgaccttgtgatccatgtgccttagcctcccaaagtgctgggattacaggtgtgagccaccttgcccagcacactatcagcatttttattaaagccattcaacaagtctctaggaggttccaaactttcccacattttcctgtcttcttctgagccctccaaactgtttcaacctctgcctgttacccagttccaaagtcgcttccatattttcaggtaccttttcagcaaccccctactcctggtactaatttctgtattagttcgttttcatgctgctgataaaaacaaaccccaaacaggggaaaataaaaagaggtttaattggatttacagttccacatggctggggaggcctcagaatcatggtgggaggtaaaaagcacttcttacgtggcggtggcaagagaaaaatgaaaaagcaaaagcagaattccttgataaacccatcagatctcatgagacttattcactgtcatgagaacagcacaagaaaataccagcccccatgattcagttaccttcctgtgggttcctcccacaaagtgtgggaattctgggagatacaattcaagctgagatttgggtggggacacagccaaaccctatcacaagaaatacttctgaaaacagaagagtattatgaatttaactggagataaaaatgactgcacaatgaagattacggaatatgaatattccacacatctcaatttgatctggaacttttctcagatcaaacttcaaattctgttagttagtatcttttttttttttttaattccccaaaagtagcctgggtcacctttgtctgttaaaatgacccagtgtgtcagataggtagtggaatgcagtgaaagctttgagctctatggaacctccaacttaccacacagtgtaagacagcatagcatgtcaccacaatttcttcaaatttactagtccatgcctctcaactgacttcgcaaaatggtctctgctttcttgcctttgtacatcatgagcacaatcagacatttacttctatcccattctttccttttcagctctccctaccccttcctgcttgactccactgtaacagatccttcgctaaatcttgcctttcctctatcccaagcatcactacagacaaacctttcttaagtacaagtcttttctccactcaaaaatttccacggattctcccttgtgtcttccaaattaagtacatgcatctttgtctgtcatccaagcccacacatctgccatgtcctccagccagagctgggtgcaagtcttccatgatactttttgctccagcttatttctgcatatttgcttattgtttccttacctaaaaggaagcccgtactgcctcaaccccagacttaccaatccttcggagaccttctctaatgttccagatcccacaaagtctcatttccttcctccattaaatgtaatttcttcttttccttgttccccgtcacattggaattgtgactctcctatggcacccagttaactctgccatgcattatctccctactcaactgaaagcttctcaaggacaggtatttcatattgacctgtgcctttcctttggagtctagcccacagcagggctcattaaatatacttttaaaggaagtagaagcttcaacacagcagtctcgaggacttatggtgttaataagctgggttctgaagaaatcctagagctagaagaatcaaaccccagcttcctcaagtctctgtgtttcattaagcaactaaacaagagagaagcaacaaatgtggtgcagcaaggaaaagcatggattctgtagccatgtggcctggggtgagtcctggctctaccccataccagctctgatgtgaacttgggcaggttacttatttctctctgcctcggtttcctcacctgtaaaatgaggatagttacatttcctatccctcagagttattaagaaaaataaatcagttaatatttgtatagcacttaactcagagcctggcacataataaattaaaataatgggaaaactaggtctccatggttttgctcttcccatgattatgacattcaattttgagatacaggcattttgaatttggagacactttctggtgatttacacttgctcagtatgaactttcctcaatagtaagtgtcaaggaataactgtcaacaaggagattctagactgaaggcaatttacctggccccaaggaagactcctactccacaactgcatcaacagtttcatttgcccctggtcagaggaggctgggaggaccccaatccctgatcagaggagcctacaatgaaaaacaaggggatggagcttcttagtcttcttattagtcttcctttccctctttcattttcctgttacttgttaatacttttcctattttctccttattgttaatttcaataatatatgttgtacaacttcatatatgctgtatgatttaatatatgctgtacaacttaaaatttgtggctaaacatctgcttaaatccttcggtgcatagatgcaaaagttggttcaattcaattctacaaacaccactaacaccattctgtacaagccactgtgcttatgctgggaaatcaaaaagaaatgagccaaagtccctgccctccaggaaactcatatttatttaaaggagacagacatgaacacacacaactgcaaggtaatgtattaaatgccttaatcggagcatatacaatgtgcagtggttacgcagattgattctgccctggggattggctttattaaaacatctaacaaattaataaacaatactggttgatttcatttcatcattccctgtgcttaatgtgttttgtatatgaggctgtttgcaggggctattgagctgaagtacagagcagtcactgatcatcatagtcttgatattctgtttacagaagccatgcccacatagtttgttctgttactgaaaatgcaaataaaagtgatacaattataaattgcaacacttttataaagaattataatttttataaaaaatttataatttaaaattggattattagatctctactgctaagctaatccttgctgtccttaaagcaaggacctggtgcatttgttttcctttgaacttccactatcagatttagattctgaccctctaaactacaaaggccactggctgcaactacagctagaaatcagacacccttgcaatccattctttcttccaagcttccctcaaaatcagctagtcatttgccggtttgaattgatgttccatctagcctactcctgtacaagttatctagtcttaagaaacaagctccacctcagacatgttttccatgtaaaattacaaacaactactgttctgaccacagtcaatgataattccccaggactcagcttgacagggacaaagaatgaagggaaagaaaactagatgcttgccagtatgactgttaaatgtcagctattttggagtttatccccacatgagatatttcttttgtactgtgaggacgatcactgaaaaaaacatgacaacataataaagccacggaagacaaccccatcattacagctgcaggaaataaaacatagattaatgtcaccaaagcacatgtcaggagggataatgatgatgtacacaaatgaatcttctcatcctggacaaagaacttaagtaccacctaaaaccggataataattatatacaaatcaccaacgacactgctatctgctaagcatgtattatactcacacattttcaaagagtttgttttatatttttctctcaaaattctcctcaagtcttcccacttgtattcaagtgacacaaattacaaagtggtgcagcaagcactgacattgcctaacaaggcaaatgcagcctgccatggacagctatgagacattgtgtccatactctaagtgccaagagcgagctgtgaacaagaaagctgtgcagctgtgaacaagagcagcaaaagtgatgtggaccatgcagaggggccatttggctgtccaaatcaaaactagatataaacaatcatttggaaaaataggttccatttgtgtttctggtcacagaaaactgcccacagagtgaaaaataatgagaaagaatctgaggccaatagctgatcaatataaggaatgtaaactccagtttgaataccaaagatagagggaactagaattattttaccttggctctaggctacagccatctattaattaatagtcttaatgtggtttagctactggatcatcacgttcatatcagccaagtgcaacctcaaggcaactgaactgctagaaaactgctttttcatttatgatgttttccataagagaaagcattactgaggaaaagttattattttacttatactaagacctttgaccaaaatttacactcaacttttcaggaatgtgctttacttcatagtaagatgttcaccaatacttgacagcaaatgaatgggttacaattactgaaaccccatctatgatttgtaaatcatggatacattctagaagcctttatatttattaagacctattaaaattcagttatttgtaaggacaaggggtggaaagggagtttgtgttttctctccctttttcttatattttttcctgttgggataaagtgtaaccagccataaagaatgtcacttgcatttgagcaaagccccctatctcttgtctgttttgcaaagccactgctgtgttctcctacagataaggagggcagcttaagtagtctgtaaaacgtaacaataacaacaatattactaatcacagctaattcttattttgtgcttcctatgtttcaaacactgttctaagtgctttatgtgaattagctcatcgaatccttacaaaactttatgaagtaggctctattattatccttattggatagataagaaagtttaggtatatatattttttctcataagtttatttacttgcagcttcaacagagtgcagaactgaaaggaggtagatttccttatctcactaaatatgtacccttcattgaaatcacatttggtcttcctcaatgatgagacaggcccttagccatagcctgttcatctgcctggtgatgatatttcctagattctgaaactcttaaagttgaagatgacctcggagtcatttagggcaatgctgcacccactgcaggaagcatattttttgaatgggtttctagccttcatctgaacacctctagcctctcttgtggatggagagctctggatgtcaaagctctcatcttccttcacactcatgacaatctttgaaatgactcctctttagaagaaaagatcttcttcctttgcagtgttgctctatgcaagtgaaacaggaaatgtcatagtttttttaaattagatcttacttaaaatcaagagtgtgatattgtggacttccacataagggaatgaagggggactaattctcatctgtgggttgggatatctaatcctcattcctagtggtcaccctctccttgcttcacactccatggtagcttcacatggcttctccactgtggaacatgctgacttttttctcacattgccttagggaaaaccactagaaacaaataatttgtagaattgatgttgagcaggaagctcttgagaaggaaagctgaaggagtatttttcttttataaacggtgtgaaaactcaccatccttgctctatttcagtgaaagaaatatacactagatttggaggaagaggcagaaatagaaaagatggggagacaggaagaagatgggaggagaatgaaccaggaggaaatgactgcagacataggatgtccttagttaaatagtgtgtgggcacagctgatcttcagaacttgcagaccactcaagactgttctggtaccaccatctaactttctacacccatgatccatcctcctccaggactcactacactgtggctcttgtttttttcctttcactatgaaaatatgctcagaggaaacacataaagctcatccacactgtgatataagtgactggctgacaactcgaaacactagccccatgaaaagtatattttcaacaagaattgaaatatcaaatcaaagggctgaagctccaggtcttgaatttcatatatcgaccaggaatggtagagatatctggggagtcagaagtcctttccaggactggcctccattctaggggctcccctggccttgctataaaagcacacccaggtcttccagatctgtgcatgtggccactcttctagaaggtggctggtattccagggacagctggcactcccttccttgctctttgccagcacacggcacacacaccttcattaaagcatttgtcacactgtactttgaggtcacatgactatgtcccccaccagactgtgagctcttggggagcagacactgggccttggtcacctttgtgttctcagcactttgtatcaggcctacatggtcacccattccttccaaatggctgccctgtgaggaaccaaacacactcggaagagcgctgcatgggtggccttccatgtagggagattcagtaacagtacaggaggttctcacgttacgagcaaaaccttgacttaaagatcaacagtcagggccaagactggctaattttttcattaaattataaatttgttagtgacatatttgtggattttatttagtggaattccaacctgctcttcctagttcagtgttgacacaaacatattcccagcaagtgaagtgttgagtaaaagctactgaagaatccattcatcattaagcaaacattccctatggataagagaatgaacaaatggataagggattcactgctacttccccttttccactggaattttctacccataacaaatacattaggtttgtctttaagtaataggagactcaaaactctatactacaacgttttaatgcatttatataaaatctgaaatgattttttttgtcattttctggattaatttctttaattttgctaccaacctaatcagctttaaatatcagaaagccattggatagcttttgaatgtaaatgcttttattttatttactttggaaactcagtttaaaatactattttttgccacgaagaagcaccttcaaatatcagattgtttttcaataaaggtactttaacaagatgtcttctctgagggatgaagagtgaggaggaggggaggaggggagaaaggaagcagttctcaaaagaagcatctaaggacaagaggcttaggaaaaaacaaagccacaaagaaaaccacttttattaccaataccctctttggtgagatgtttaaagagttatttcaactgaaaggtctgagacaggattaaaggcactagtgttctctgatacatctaactaaacaataaaagctgaagaagaaggctagtcacatcattttgccttctcagcaagtggctgtctctgtattaaaaaaaaaaaaaggctttaatcagtataactgacttttgacggtattaataggctaccaggctgatttcttgccgtaggctgaaaaactgcaaccaacatgagagaaaattacataaccactgaagcagaagacaagcaaataatttacacgtgactcaattgagatgtaggaccctgccacgatgctggtgtgcctctccttagctttgtccaccatggacataacatacatgttttggtgccatagtaaggcgatatcttataacaagataatagcctcgagttcttccccttttgaacaacgtgaaggtacaacaactcatttgtaaggtgccttgttaaaacaaccacagtcctcataggaagaggggagggttaagaatcaacgcaattcctgtcaaatgtgtatatgctgcaggcttatgaaagggagaatcaattcactccagcaatgagtaataacatctatgtccttgaagaagcactttgagaaatgctagagtcacagaactatacatccagtgacactgattaaatgctctatttggtctacattttattgaaggtggaggcagagcagcagattaatattgtttgctcctgcttataggaggaacattgggaaactgagtaggcatgtcttccaccagcaaatgccatttgagaattactggtactttctgatgaacttcactgaaattaatattttatataatctcagtgtagcaggcaaccactttcccaagttatataattgtggatcactgaagtatctgcctacaaatgcatgctcacatacaaacacatgcagctggagatgctacagatcttgttgtccggaacttgcaaccttgcaaattgcttccgtggcaataaagactagaattgccaatacagatgacgcacctcagtgaattgaggaagttaacgtgtgagagtgagtgtgacccagtgggctcaccagcaggctgaaggagtgaaggcaggaacaatgtgtccttactacaaccacctttctgattttcccaatggcgtggaggaaattatttaccttttccatgcacaggtcatagtgtaaggatatactatgtaaaataaatatgtcagctaaacactggttatacacaataacatctatccttttgatatggtgatattttattagtggtgactgaggacaaaagcaatgcttagtttttcacataacagggtgaaaaaaaactcaggtaacctgacccagaggacactgctgcacattagagtaactgagagacctctaaaacaattcttgtactcagcccacactccagatcaactctgtcagaatctctgggcatgtgacccagtgtttaaacctccccaggtaattccaacatgcagccactcttgagaaccaatggtatgggattccacaacagcacttcgcctccctaatccagtaggtcttgtgcatgagcttgcatgagaatcatctggagctctgttgaagagcagctggttgggccccacccccagagtttctgacgcagtaggtttggattggtgtttctaacaagttctcaggtgatgcggatgctgtggagggaccatatttgaggatcactgcctccatcaaaggtattcactgtacgaatctttctccaaatggaaatttttttttttttttttactttagcctttctgaaagtgtgtttcttggaccactgccatcagcatcccctggaggaaatggagatactgaggcccactcaaggtgaggcctcgtaaacttcaggtgccaccctccccaccctgtgattatgctccctgaagtttgagaaccactgttttacctcctctttctgcatgcttatgaaacagttctcccctaataaccaaaatgactcaagcatgaaaaggccaccagaccccaacatgagaagtgagaaacagcgaattccctgtggtgaggaatcttcactgcattattctgtgggccaggggacaagggcacgggtaccattttcagaacacatgtctgagaaattaactcagtcatggagaaaagtctgtgtatcctgagcacacacacttcgttatctctcttattgctgcaaatcctctgaatataggagggaaaaaaaaaatctccctttccagcaagttcactataacaaccaatggtctttttgcaatatttgtaatgtctttttggctatacctacttctacctctacacctcttgaactcacaaaaaataacagagtattaggaaaggaggatgtttcctttcccatcccaccttgctgacactctcaggtttaataagtaagagctagataataagagaactaaacaatattttatgagtttataatttaaaaattagtaacttgtttgaaggacaactgttggagctattcaagtatggcattttatcccaaatctgccactcaccaggttgtagccttggaggaaattatttaaccacctgtacccccatttcctcatctataaagtgggagtaataataaagcctacctcatggattattgaaatgaactaaaacatataaagcatttggcacagtgcctagcttatagcaagtgttcgataaatgtgagtttttgttttcatttttatatagtggacacagcaaatgctgaataaagaatgaaataaataaaaaactagccaaatgaataatatcaaaagcagtcctttaggactgtcaaacttcaaattcaaactaagttattgttcagggaacctaaaattcaagagtgcatggacagagtataattcagtatgaagttcaccaacaaaagtgatcccaaatttattttttgtagattggtcaagaccaagattattctgtgagggttatttctgtcaataaaaagaaaagaaggattcaggtcttgcacatcatgggacagactttttttaatcttttcaaaaaagattatgggaaatagcaagctgacggtcaccgctgggtcagcacctggagaagctggggcaagccaatgttagaggcccgtaaagtggccagacacaagcaggggactgaggaccacatgggcaatgaagcttgaaaaggtaagccaaacgggtcagggatctgtttaactttactctgtcatagagattttctcccatttttatttataaataaaataaggcatactccctatttcatggtaccagtaacctccacttattttaccagacaagcccaaagtgaaaacttagcagttggcggggtgcagtggctcatgcctataatcccagcactttgggaggccgaggcaggtggatcatgaggtcaggagttcgagaccagcctggccaacatggtgaaactccatctctactaaagatacaacaaattagccaggcatggtggtgcgcctgtaatcccagctactcgggaggctgaggcaggagaatcgcttgaacccaggaggcggaaattgcagtgagccaagatcacgccattgccttccaacctgggcaacagggcgagactctgtctcaaaagaaagatagaaagaaaaaaaaaccctcagcagttggcctatatgttgtagtttatcattcagagacatgccgaagactcagaatcagactcacactcacagcccattttatcttttggaggcttaatctcccacttaaattcagaaaattcttaaattcgtttttaatgatgatactcttattctcattattacatttttccaacctgatactcaaatgtaatatagtaatacaatgcaccattaagtctcaactatatttaaatgtatatcttgagccataatcatacaagaccttgcacagacacaacacacacatagatacagcaattcctataaagccaatgataaaattaaaatcaaaccattgagtacatcataaagtaatgcccatatgttgtttattgctatagatccatagggtatatgttaaggctgaattaaatttggggttcattttggtccaaagagacttggagataatttacttttggtcaatcccagcgcagagaggtccccaggaatgagtcagttcttaggctcactcagatccacagagttacacaaatgacctggcttttcagagcctactgggtcccaccccaaggccagagagtctcctgctgttggtttagaaagaaagaaagttctttaagcctgtaatgaataagaaatgttattttactagctctgacaagtgtctaagtccttagggtttgggccacatacagccaaaagtctcagatctaaatgaggttacatctgtggaggctcactgcaagtgccacggtctatagaaaagttttcaacatattaaaacaggatctgcacatacaaatggttcataaaaaggaccaaaggaccacaggaaaattataataaatatggtgataataaaggcgataactaaatagccaagacttatggagaacttgtattctagatgctgtgcagatattttacatggttatctcatttggtcctctaacagccccatgagataggtaagatatcatccccattttatagtttagggaaatgaggcttagtgatttcagttatttgtccaaggtcatgtgctcatagatggcagtgccagaatgtaaacctggtcctgtgatgtccagagctagagctctccatcccatcctcatctgactttcaatagagagcgattaagcagaggactcccaggtgtgtttagatcttaaatgagaaattataaaacacagaggaattgtcatataatcaagaaagaatactaaaatgtaatcccaaatgacagtgcagggagctaaaaccccaaataaaccatatccttcagaaaattgctgaaagcaacacattttattggtggagtccctgattgagaacatcaatcctgttggtgccaagcttcagccacagttgggcattttgaaggattaatgggatatgtctttaacagaggggtgtgaaaccatcaacaaaataacatgtgctaagggaaaaagctactattactaaaagacttgatctgaaaaggtaaaggcctcaggttagaggggcacctgattttgggttcattggtgtgtgttacccccaacatctaggcttgtgcggaactctggggattggagatagaaaagcattccttctttaaagccccttaggctttggtgagcacaaagtagctcagctctgaggcccttgtgacaaagtatagcacaaatgggagggaaagagcttttctcatttagactgattattgaaacccactggagacccaaattaggcctgagcacaagctggtagccatgcctcagaccatcaagagtggcaagatataagagaggaaaccttcccccaaatgtggcagctgggaaaatgaaacttcctacaccaagtggacaaaggatttccaaaacaagctggagtgcttgtctgttaaggaaattcaagaggaggaagaattctgcaattcttcagtgatgggtaggggtccacacaatggaatgggtaaagggaggcagagctgagaaatgacattttcgtagttactgaggtccgcatttaccttcaggtcagtgggaactttgaaagttgaggttaatgatgttatgtctggtcttggcaagaacaaagaaaagaaccaaatcatcgatgggcatttgggttggttccaagtctttgctattgtgagcagtgctgtaataaacatacctgtgcatgtgtctttatagtagaatgatttataatcctttgggtatatacccagtaatgggattgatgggtcaaatggtatttctggttctagatccttgaggaattgccacactgtgtgaagctggaaactatcattcttagcaaactaacacaggaacagaaaaccaaacaccgcatgttcttgctcataagtgggagttgaacaatgagaacacacggacatagggaggggatcatcacacaccagagcctgtcagggggtcgggggctaggggagtgatagcattaggagaaatacctaacgtagatgatgggttgataggtgcagcaaaccaccatggcatgtgtatacctatgtaacaaacctgcacattctgcacgtgtatcccagaacttaaagtataataataaaaacaaaaagaaaataaaagaaccaaatcactgcttttgttttgtggggatgggggttaactgctgtaatgttaagaaaatataaaaagcaaacagaagtattaaactttttggcatgtcttttctttatcaaagaaagcataatatgcaaaaatatactatgaggcagctcttagtgctttagtttaagtggactcaagacttcacacccaatggtttacatcaaaagatacaaatgatgaagatccaagaactgctgtgattaatctctgcatagtcatgggtaaacctgaatggtgctagaagatgggagttaaaaaaaaaaagtatcaaagttcaaagttcaaaaatggagaacagtatatttgacaatgaattcaatgagatattgacctgtagtagtaaaaggacaaaaccaaatgcttgaaaagtgactttcagggccaccatatactcattgtgtgactagggaacaatcttcctgcctctaatttgccatccatagaaatggaattcattaagatcattaacaggctcactccacctcctaaggtctgagggaggctcaaatgagatcatgttttcctatgaaaatgctctgaaaaccaaagctcttaaagttgccatgcccaatagttctatctacagtttatatagacagaaataaactcaacccaatatgaatgtgacacaactgaattaatgtgttaagaagtgacttaatgaagattaataaagcactcaacttgaacagtaagacaaaatccaaaagaatggaatgtaacagggacacacttgtcttaatatgtaaaacattattaatatgcacaggcctaagcaagtggggaggtgtagacttaactttggagcctttgatgtagaaaaaactttggagatttctttttaccacaagctaactatgagtcaagaatatgacctggatgataaaaagaaatgcaaccataggctacacgaatggaaatatcattccagtaagatagagtgggactggagctacacttgtactattgcagcctcaatgtactgtttggagagtgctttagatacactggcagtccatgggattttaagggctggcttagaatcctaatgaccataaacaagttttcatcaggaaaacaaagtattcaaagttctgaacagtcaatttactaatatactttagaatatagctcattaacaaagagggggagggggagaatacaggtacttggggctgtctcttacacagaatcactccctcccctgtgcaagcctctcatttcacaggtgcttgcttgcaaagatgatttggaaagatggaggtaaattaacatattgatttcccagcactctgaaggccataagcagacacactgggtcatgtttcaaatgatggaatgtgaaattaaattaaaggatgcatctgtgctcagcccctaattgccagcctagtggatgtttttaaggagcacagagagggaggagagagaataggaagaagcaaggtgaatgcattagaaagcctgaaaaacaagctgaaacaaagggggttgggacaattaagaatttctatgtgcagattaaagttgacagtgtctgttaaatacatctccataatttaaaatacacgtgagaggagtcatcagttggcatctttgacaacacagtagaagttgtagaatcattcccctggccacatttcaggtatctgaaaatgtaatatagttagaggaaattaatagctgggtctggttttttaaaatcatcttcatttgtcaattttagctttaaacatttgtcatgttagctttaatctaactggttctgggatggaatctattacaaaatagatcctaaacaaaaatattcacttcatctgtggcctatttctgtggtcaatcagctataaactagcctgtaactggacagagacctttcatttgatgaagataaaaattttaaatatatttaataataattatttataaagttatataattcacctctatttggtataaaataaaaagcagagaaaaaacaactgctctttctccaactctactgtgcagaaaattgatattctgtgatatactgataggtgttactagggggaaaaatggttttctgtggtcaaatcaatttgagaaacactggaataaagagttttctttcccgcagggcttctcaaaacgcttaatatgcttatgtgcaaggaggagggagacacagtatagcattgccaaaatggaacatttgttactatctccagggacccacacgttctgggaacacaggctaggaaaggctgctcagactcctgacccagcacacaatcctctgtccaaatccagttgcaaatcacatttcaaagattctgaaaactaagtgatggtatagtcaatggcctaatgacctcagcagccagatgcccaaggctacaggccagaaattgctgcatagtttcaagatgacaaaacagatagaagcaaataaagcgacaggaccctggtttaactgtatttactgtcacctacataggtatccaattcagtcctactcaggtttttgtatatttaaagaaatgcttactttagggattaaaaataagagaacaaattgactatttctatcctgaacactaaagatagaatacgtacttgttctcagctagcagtcaagagtaggtaatacaataaatcaaagactttcaccgacagttgaataatcactgaataacaataactttaattagtaaattaatgacataggattatatagcataattcaaacagaattaagcaaagttctagtcaaagggagagggtgtaaaaaaataagaggttagccctgctctcaagaagcttataataaagagtggaacacaaggacatgcacaagtaaatacagagcaatatttgctataatcgctgtaaagtgcaaatccatttgacagcccagagaagaggaagagcggggtagaatctacattatttataatttagagtgcagagtgattgctcaaagtgacgccaataagagaatacttttgcttattagattggcagaagtaaaattgttgatgaaatgccatagtgataacaggaaaacaatcactcccaaacactgtggatcacatacatttgtacagctttttcagaggcaacttggcattatctagaaaaattaaaaatagacattgtagctgtcattattaggaatttatcctgcacataagatcacacacatgtgcaaagatatgttgattccaggatatatacacggtcttgtagttctgataaaaacaggtcagaaacaacctaagtatccatctcaagagaagactggtaaatacatcctctgtaccacaggatgctttgtggctgctaatcagaacacagcagaccttcttacactcagagtgaaaggctcagtggtgacaggagccttgaaagtgcaacaaagtggcaaagccacacaggatctgctgcactccccaccctgacctcactcacgctgtgttcccctctcttgcctcactccagccacactggccttctgctcctcaaatgtgacaggtaccctcccaacttggtcttggtgctgccctcctcctcttggaacacccttccccctgagattcacctgtaactaacccccttgaatccttcaagatattgagcaaacctcaccttcttaatgaggtctactctgagcaccctatttgtgatggaaactgccccccaacacagaattttactttttctttttattcacagtacctatgactttctaacacacttgctatataatttacttacttagatgtttatcatctatctcttgcctctaaaatatagtctttgaaggcaggggtgttgaacagttctgtttactgatgtaaccaagtcccaagaaaagtgtgtggcacatagtaggttgtcaataagcatttgttgaattgaatggaccacacatatatgtacacatacatgcagatgcacatgcatgcatacctacacacacacgaacacacactttacctgagtacagaataactccaaaaagtatgtaagaaattgtgtttgactttgagaagaaagactaaagaagggaagatcagaagcatgcagaaatacaggaagtcttatttgccaatgtttaccctattatatgttattactttctttctccctccttccctccctctctcagtgtaatccattatagtagccactagccactcatagctaatgagcacttgaaacacgctagtccacatcaaaatgaactgtaaaatacacaccaaattttgaagaataatataaagaaagcaaaataccttactaataatttttatgtggattgcatggtaaaattatactatttgcaatatactggtataataaaatacatcattagagttaatttcacctgtttcttttggcattttaaaaggtggctacagtagaatatacaatcatatatgcagcttgaatttgtgatttgtattatatttctattgaacaataaaacgatctctccaaaaagaaattttacacacacacacacagacatattattaaaagtggcaaaaagactctgaagttagatagataggcagtcatgaactaaaaaccagctttgcttttacttaacttctctgagccttagtttcctttgccagtaaatggggatatgatcccctacaatattatagtggaaattaaaggagataaatgcatataagatacttgctacataaacgtaaaccatataatggtacagtgctggatttgtttctagaggaaatagtgtataaagctactataaaaccatgagccctaccaccaagcaagcagtaagacagtgtcgtttttctgcatgtttgtgtagcccgtgttacctatgacaaaaaaagaatgtaaagacaccctataaagaaacaaatcttgcacagaaaaacacaaactggagtcaaatgaagaaatgaataatttaattttcagtgtagtgctggaggtgctccaatctatgacatttctatatgtaaacagtctgatatattcgatacgtgcaaaattgctcagtagtaaaaactttagtagacataggaaagggaaaggggaatcaatggaaagctgtggagcttgtaccaacactgtccagatgtgacaggtgatcaagatacgaaggagaagtctgaactgacctcacctctagccaaaatttgaaaatgtgaggaagaactctatcccgttaatgtgagattaagagaagaacacattagctggccacatagctttgggagcacttttccccaaaaagagaaattcaaagaaaagatggagaaatcagaaaaccggctcaataaagatgaagtgctatacttcaggaaaatgtctttgttaacatataatttcaaggagaaaaactgaaatcagatttaagttgcccaaggacaatttgtctttcctattccaggtcaatatggcaggttttcaaattaagctggactttactatctgacaaaccacaagacatcaaacagaataataagaacctcttgaaaataaaaatcatgtgtaatgtagtgtagcatttattttagtggctgaatttattttaatggctttagaaatgattttagttctgtattcaaaaaaaaccattaagagtcacttaaatttttcagttacactttactgcattttatggggtagattttatgttataatactggtgaatttgtggatacaagaagaccttctgggcatattcctcatgaatgtcacacgtttattgtatcaaagaatattaaacatggaaacacttcttagtaagctgaggttcacaagacaaagcagcttagagatcataatgatagttatcatacaatcgggaaacctggattagtcattcacttttcattcgttcattcaacctactaatatttattgaacatctgtgtaacaggtactgggaatacagtgttgaacaagacagacaacattccatacataatagtgttttggggggacccagtaaacaagtaatatcacataatatgtgcagtagtgaaaataaaatggaataatgtggtagagaatgatggggaagctactgtagacaggaaggtcaagtctgaggacatggcatttaaaatgatatttgcatattaagaagtggtcagccacatgactatattcaggaagtacattccaattgaaaggccctaaagcaaagttaaagaacataaaaattagtgtggtgaatgtatcaggaggcagggaaggagcgggagatatggagtgggatttcatttggggtgtacttgggtaagatgttggtggtagtggcagcataatttgaggttttcccaagtccccacataaaaacagagcaactagttggtcaaaaccctaaggacaacacatacatcaaacccggagatgatgtatctcacaaactccaaattataagcaagtgaggacaagctaccaagaagagcaggaatcagtgtttgtgcaagagaaagcagagagaagcaagcaggcatctgatggatgcgggaacaggagaacctccaaatagtcagcaggtgttcactagagagtgttacatgccagtttggtaacagtggttgaaaatacccaagtcaaagccagtgagggctatgggctcacggcaagacccaaggggccatgtctgtagcagtcttgcccctgtgaactcttgaatctgaccaggtgggctcccttccaggacaggaccccatattgaggagaaactgctgggagtggaatcaaaattaatcaggacaggaacaacagcaatggaggaaagagaagatccagatgaaaggaaaggcatactttccaaagcagcatcccacaatgtctcccatgtactgtttacagtgtcaccttgacacctttcccattgagtgatgaggtctatatcctctccctttgaatctgggctgaattttgggacttgatcaacagaggatggcaaaagtgtctttatgtgacttttaaggccagatcataaaaatgccatgcactgccgctttgccctcttggaatactctatcttggaacccagctgtcatactgtgagaaagctcaaactagcccatgcagagaagccacatgtaggtattctggctcaactagaatacctgcatgtgctagaatacctacagttgagctgaggtttcagctaacactaagctgaggcccaagacagcgtggagcaggcaaactgtctgctgtgctccatctgaatccctgacccataaaggccaagagcatgataaaatgattattgttcaccactgagttctaggggagtttgttacccagcaggtaacggcgataccacagttttaattaaatattctgtctcgtggtaacatttataaggtacacttactttaaaagttgtcttaatttttggtaaattataaaacaaactcaatcccagtggaagggttcccctttcaaaagagtagcttaattgattggggtagcacaatcaattttcccttgctttcaatggcatctcttgctagaaaatgcttcaaaaactgtgccaggggaagtctgtttttgtttttccaaatgaagcagtgaggcttatttaggtatctttctttctgtcctttttaaagtaacttatttgcaaatggtagaaattgattaagtagaatgaccacataatttatcatccaaactagaaaaaatcatcaaaacagctttattgagatacagttcatataccaaaaaaattacccaagcaaagtatacacaatgttttcttattacactcatagagttctgcaaacatctccacaatctaattttagaatttttttcatctccctctaacctaggacaaattgaaaatgaaaggagcactaataataattatgcaagaacaataggtatgaatttggtatatccagagtctgtccaaggcaaactgaagtgaagcatcactgaggtagaagatacaggtattggagagaaagctgtataacttaattcaaaataggaggctgcatgaaggttttaaaacagataatcagaaaccttcttaggtaggggaagggtgtataaattggtatagccatttttgaaaactatttggcaatatctatcaaagctgaacatatgcatgtactatatgacctagcaattccactccaaaatataccaatggaaatgactactaaccgtatgatgatttcatttatataaacttcaaaaacatgcaaaagtaatctataacattacattccagatcaggatggtggttaaccttggataagaattagtgactagaaggagaggcataaagggaattttgaggtgctggctaatgttctacttcttgatctggatgctggtacatggttatgttcacttcttaaaaattcattaagttgtacacttagaatctgtgcactttttatataaatgttacacttcaataaaaatcctatatagaaatgaacaggtttgtgtttgataaagagatattaggaattcggattgagatcggattttcaagccctcccaattaacagaaagctatcttaaagaaagcaattaagagcagttagtgttcacacagtagcaagtggttgttaattttcttcttaacacctttctctggaactggaggcaatgaagttcctggggaaatagaagtggtgaaaaacaaaaggtctttccctgacataaaggaatgtttaagtaaagactgaaataattaactaccaattagaaacggagggggctttttgttttagtttgagtttttaaatgcttctgctaaccagaatagtattttagaattggaagtaattttcaagatcatgcaatcaatttctttcacttctggttatggaaactaagattcagagaactgatatgatagccccaaattgcataggtagttagtgacaaagctgggatcagaacccagtactcttgactcatgaaagatttttcctatttacaaaggtagttactcttactgcttgctatgtaacaatctctgcctaagttttcctattgctctcctctccacaagagatgatagataggtataacagttatctccattttacagagaaggaaactgaagatggttagagaagttaacatactttgacaaaattaaaaatcagttaagtagagatgccaggattctgatcatttctcactctggagtctgagattttaaccaaggggcaatactgcttctttgaattaatagtgcattgccatatttctcagctgaaaggcaaatgagtaaaggtacttttttttttttaagacactctgtcacccaggctggagtgcagtggcacaattttggcccactgcaacctctgcctcccgggttcaagcaattcttatgcctcagctacctgagtagctaggattacaggcatgcattaccacacttggctactttttgtactgttttagtagagacatgtgttttgccatgttggccaggctggtcttgaactcctggcctcatgtgattggcccatctcagcctaccaaagtgtttggattacaggcgtgagccaccatgcctggccacattgtttcttgattattataatgtcatggggaaaaaaagtgcatagtttgtttctgtgtcacagtccagttctcatttattcatatctgagaaaaatacatccatttgacaatggctaaccagtggcacccgcattttcctcttggcagcaacttataagtgaggtggctgtgcttaaaggtctaggagttaatcaacactcagagagatgatcttgcaaacatgacatgctttaatgatacatctttatttccttggcaatgttcttaacaacatttgataagcagggttaaaaattcatggccaacacatcgattttacagttttcttcttaagtatccacagatatttaagataaggtattctaaatagagtctaggtaaccacttataccttaaagtgctaaaaaaatactagttttgagttcaatactatctcaagtattgaactcaagtttgagttcaatatgaaaaaattcagataagaaattatatttggcaaaagacagcttgcgttaagatttgattttcctcacattctttctaaatatctaacctgtagtagaactgagacatttaagaagtgcaggctcattcatcatgcattgcaaaatgcatttcctttcaattcattcatattgtaagactatcaaggttaacagaagaacaaaaatggtatttactttccatataatcgtcataattttaaacttatataattaagaacagagggacagcagggaaaatggacgagaaggcctccaatttaagccaatatttcctctaatttttttttaagttgtaagtagataactatgttacatgaaaagtaaaataggaggattgagcataaatgatcactttatccagctataccccaaggatgataaatacgtggcctactttcactcccacagcagacatcactaattgatagggcctgctttcccaacaaacacagattcctctgacctcagaatttcccaatagtaacattgattatctattatttgcacagcactgtactaacctcttcacatgcatcatttcatttttataacctcacaatatcctaatgaggtaggtaatattatattctcttttagagatgtggacactgagaatcaggagttagttagcttaacagttggcaggggctgagtggcattgaaagccagactcattttaatccaatgtccatgctcgtaatgactaccctctaaagccagcttccaccagttgactgcagttagcacctaatctatttgctatcctaatttttatgtttacattcctgctatagcatcactaaccatggtcacaggaaagatgttactgctttcaggaaaaaaaaatcttttttaaaaactactccctggtcttagctttgtttttaagagtcacacaaagcatactcatgggttacgcatgttagcactattgtacctccaacctcctctctgttatttttctataaagtctcgtcttgaacagaatagacaccttctgttctttcagtcaggccatatgcacctttcatatgtctagtcattcttctctggcagtgcttcagtttgtccacatctccctgaagcaaataacatgttgcctgtgaggtctgaccagcccagagtacagtaggactaccactaccttccgtgttctggctctctttcttatcacatctgaaagctgatttttaaatcaatttcatactccactgacttgtactgaataatattttactaggtcaccataggccttgaactccaaataaaaaggtagatataagaagagggaagtagaaaaaagttaagagctacttgaagaaaaaaggttgagggccaggcatggtggctcatgcctgtaatcccagcactttgggaggctgaggtgggcagatcgcttgagctcaggagttcaagaccagcctgggcaacatggtgaaaccctgactcttccaagaatttaacatacatacatacatacatacatacatacatacatacatatatatatatatatatattagttgggcatggtagcactttcctatagtcccagctgctcacgaggctgacacagggggatcacttcagcctgggggatggaagctgtggtgagctctgattgtgccactgcactccagccttggcaacacagcaagaccctgtctcaaaaagaaaaaggttgaggcgatggaaatatttcgggtgggagaggctgcaagttccccatatcaaaatgtgtccttttatttaagtagaatatacttagccaaatgtagtaaagtgacccaatccaaaattctctcttactctgcctgaaattccatcatttagagattcatttgggttaataagcaaaaacaaataaaataaagccaaacaaaacaaaaacttcattaataataacttggattatcagacaatcacacacttaagtaacctttaaaaggaaagcagggctgggcatggtggctcacacctataatctcagcactttgggaggctgaggtgggaggattgcttgaggccaggagtttgagaccagcctgggcaaaatagagagactccaactctacaaaaaaatttaaaaattagccgggcatggtggcatgcaccaatagtcccagctattcaggaggctgaggtgggaggattgcttgagcccaggagatggaggctacagtgagatatgactgcaccactgtactctagcctgggtgacaaagcaagatcctgtcacacaaaaaaataaaaataaagcaatttggtttagcaagtgacactaagtttttgtattgaaattatagctttttgaatggaataagggttgaggaaaaggtgaagacgactaggaatttggagttgggggtagaaaatcaaaatcattctgctagatggatatgacaaccacattttgcaaaataaaaatcaatacacatggtcagatagaggaaagaggaatttggattggcacagtggccacacacatgagatgcatggataccacagaactttgttggtggacagacctggagggaacagcaccgtgtcttacagcaaactgcaagacagcagcagggctggggacagcttcaggaggcaacttcaccttcatggccattcaacctgagactagttaggctgttgctttctcttcctccccaacccaaaccatgtatctctggtctcatcctcagacactgactatggtctgcttttcccagcagcccccagtgctttacccagtatctactggtgagcactcaagggtgaatgttgctggaacaccaaatactctgcctgggaggtgctgcagctggagggagaatgatgagagccttggtctattggctctccagacatactgactcccaagggtcctcacatgactaggaaggggagaagccaacagtcattatcgagaggagccttgagcaacacccagtttatatgggactgcagggtggaaaacagcactaaggcttaacaaatgatctttgcttttgccactgacctaatacaatataatttaatcttaagaaccatgtaataattctattttctctctgaaaaagaaccacagctgaccctcaggtctaatccttttgatacctgaaagtgggggtgcagagtgggcgctggagaggaaggagaagaaatccaaaacaaaacaacaagccagctgctataaagctgtgactacagcttatgaggtttaaatttacgcacaagtaaccttggatacctagtatttgacccctaaatggccccagctgagcccaattactatctgtgcacacacatctgtgttttctgtaagtcaacacagtaataaggctttgttttcattctaaagctccagacagatgaactgaattcagtcctggggatgtgttctactaacaattaaaggttacacagaaagtttaggacgtttgtttccagaagacacactcatattgcaaaactgtggcttagcttttgctattgattttaaacaatatttagcaaaaattcttactgaggaggagaattctcttcccatttctgccatcaaaagaagatgttatcctgtacatctttaagtccaccagtgctatgagttgaatgtctgtgtcttccactgtgccccctcccctgcaaattcatatgctgaaatcctaaaccctaaggtgatgatggtattaagaagtgaagccttggggaggtgattagatcatgagggcagggcacagcttcatggatgggatcagtgcccttataaaagtgatcccagagtgttgccttgttccttctgtcatgtaaggacacagctagaaggcaccatctatgagcaacagaccctcacccaacaccgaatctacctgtgccttgatcttggaatgcccaagctccagaactatgagaaatacatttctgttgtctataaggtacccagtctatagtattttgttacagcagcctgaatgaactaagataccccccaaaagcaaactgtatgagttagaacaggtagggacttaaagagtgacagaagggtgccgtgggccttagtgatctgcctaccatcagccaaggcgccttattgtggtcacagcacctcaaggtttactttcctccactctgagttcatatgatttagattttggcttctgtcactttctccgggttccaggggtggggaagtgacccaggattggtcaactggagtatttcacacacccctgccataggggtggtcatggggcacaagacagattgatagaatccattcaagactatttagaaagcaaagttgagtgccaatggagaacagaacagaattctgctgcacctactatcgggacaacactgagactcttttttgttaaatacaaaaaacacaaaaataaaatacttttttttttttttaagctaaagccagtttgagctgcacttctgtagctttcccttaaaaagtctggacacagttgaggtcagtctgctggaattttatttctttgagtttactatggttgaacaataatatttaacatgaataaggtaggcagtattcggatggcccaaatgattgagacctcctagtatcctcctagtgttgaatactagggagatgtaatcccttcctcatgagtatagactggacctaatgactctcttctaatgaacagaaggctacagtgatgagatgtcacttctgaaattaaatttaaaaaaaaaaactgtgttttttttgtcttgcatgccctttcttgctctctctggcccacctattctaagagtgaccagttgccttgtttgagctgctcagtggagaggggcatttgccgggagaaaaagccctcacaaaactggtatctccatacaatagccatctagaacttggatcctgcctgcagctacgttggtgagcttagaagggatccctccccattccagccgagagatgattgtagccccagcctatactttggtcacagccttctgagagaccatgaacccgagtatccagctaagctgcaccagtattcctgatccacagaaactatgagagaagaaatgtttgtttttttaagctgccaaattttggggtaatttgtcatgcagcaaaagataactgatagaaaggaattaaacttaaatagattaacaataaaatacttatcctttgcctttgtgttatgttttccaagacaactctcaattactttatttttaggactttaaaatgcaatttcagtatattcaaggtcacagcataattctattaggttgacagaatatagtatttgagtagtaaaattctttacaaaaaggctcacacttgaaattccattctagtttagatgaatctgttttacaaatacacattgagaacctgcaatgttctaggcacaggagaattaagtcggatgggcagcttgtttcaaagagctctaagtccattcaggagaggagaaaatcccataagatttggaaataagtgaatcaggaggaatgccagtattcactagttgtgtgacactggataagccatttaaattttcagtgcttttgttttctcatctataaaatgaggaataacagtaacaacagctaatttatcaacttataagatggctagaaagaccaaaaaggacaatgtatgttatagcattgtaaaattttaaaataatataaaattataattattgcaatggttattaccaaaactataatatacaaactttgctgtacaaatagataatggtccataattaatttgctgtttactgtcatgtaaaaaattttttccattaactatttaaacatgtccttaaatttgaaatttgtattctaaacatagctgttttgatcactcttttcaaaaccatgcaatccgaattacttctcccttgaatataaaactctcatactttcatcttaatttattctctgtgacaagatagttacagtaattgtttacagaaaaactgaatgaaaattacaaggaacatgcaaattctaatcattttgattagaccaattaataacttttataagcagaaaagtttctatcttataaaaaggagaaaaaattttatttgatgttaaatttaaagtgtttagagctaccatttagaatccattaaatgttatcattacttctattgccttctccactaagctttaatataatttgtgattcattagatcaacattttgaggtcactgaaaaacactttattttcaatatgccactgtacttaaatttataattctagtccaaacagcagatcccttaataaaaatgcaccagcaagaataactgatttcattttagggaaaagatatcaacaataaactgctttggactgcgcaatcaatggttattgaattctggactccaagctaatatttccagctacataggtccttcagactcaagttgcccactttgcttttaatgaacaaggtcagaatcatgaatataagtactatgacaggaacagaatactttacctcaaaaaattttagccttgaggcatcgtaaactgtcaagtatctttccagtaggcctaaatattaatatacactttaaagttggagatagatctgtcccttgaaatccactattctagttgtctacagtttggtgtgaaataaaataaaattaaacatttattaagctctaactatggactaccccgggtgcagagggaatacaaagatgaagtataaagtagatgaaatagataaaatataatagaaaacttagataacgtaaggaatgagaaatgaattcaaggttcctagtttttagaggataatgcctttatagctaaaagagagaagaaaggtactgggaacatatttgggtaggagctaaggtattgagttcagtttaggaaaagtcaaaatctgaggtaatgcaccacccagaagacagttggaaagatagatccagagctcatttgtgacatctaaattacaaaacgagggaggcggagatagcccaggaagaattcagagagttagaagggccagtgctgaaccccagagttaaggggaaggagcgggaggaaggagaaggtatcaaagagaggctggaggactggaaagaagatgggtcacagaagccaagacaggaaagactcaaagaccaaaatgatgactggtacagttgctacaggaagctcaacgaagttaagaaagtcttaaagaccactaaatttggaataaggtgatcgctggtgatctctgctgaatccttttcagtagaatggcaggtgcagaatccagagggccacaaggcatcgctcaatcactctaagtgaaccaggcatctgctttgtgttttggggacaggaaagtacgtgctgcatagtggaagtttttgtaaaagatatttggaaggtgggagaagcagagtcaagtaaactaagaagtagcctctatcttcagttcagagtgtgtttccggatgggaggagcagactgggacttcagaagagaggtgcgatttgggaataattgcttagggaaagggaaagagagtggctggagataaagacaaaagattgatgactagtgttgagaaaccagctgaggctggaactcataaatctgtaatgtagccaaccaccatggttatacagtttttttcttccagtaatgtcagtagcaggagtgaagaccacagatggtttgatggagctaaggttgagcattggcagggttgtaaggatgaagtctcgaggagaaacaaatacttgaggggcctggtatcaggcctggtatcagggaactgaatacctaatcaaagaataactcaacaatactcttttttgatgtccttaatattagatatgtattatttcagcttttggggtacaagtggtttttagttacacagctgagttgtatactggtgctgagattttaatgcacctgtcacccgaatagtgtacattgtacccaatatgtagttttctatccctcattccccttaccctccctgcttctgagtctccagtgtccattgtaccactccgtatgtctttgcttagctcccactcaaaaatgggaacatgcagcatttgatttgccattcctgagttagagaagtcaacaatgttctcacatgtggggatgactggtagggaattgaagggcctggaaagtttaacattctggatttctcatgagaaagaggtgggaaaatgagattttatgaaacttttgaggagaaaaatagatacaaaaatagagaaagaacctgataaatgtaagagctaccaaatacgcttaacaaagcaaaagaactgatttggagcttttagaaatgatacactttactacgacttttctctacaaagcttaatatttgcactttgttcataacatcaaacaactccaaatcatatcagaccatttctttcttttttcttttttgcagtgcagtagcatgatcatggctcactacagccttgacctcctgggctcaagtgatccttctgcctcagtgtccacacccccttctcccaagtagctgggattacaggaacgcaccactatgactggctaattttaaaattttttgtaggagctgggcatggtggctcacacctgtaatcacagcactttgggaggccgaggggtgagcttgagttcaggagttcaagaacagcctgggcaatatggcaaaaccccatatctacaaaataaaataatttaaaaagtaaatttttcatagaggcagagtctccttatgttgcccaggctatatgggactatctctgaggtttgctattacaactcaaactaagagatctctgtctcatttaaataaaatattgcaatttctgattgaggaacactcaactttacaaagtaaaaactaaaaagtaaaaaacaaaaccttctaaatgaaaagaaaacatacctaattgtctgagaaaattacaacactccaagtagaacactttaacaaagccaagctcaaactggataacataaattacataacttgacactaagagttccctgaccactgttgccaataatccaaataatattcactaaaaatgcatatattttatagtaaataattttactctctttgagaaatatttcctatcagtaaatttgatatgtaagtatttactttattcatggaagaggagaatatgattcatgtgtgacttagcaatagaaaatataaataaataaaactagttcctatatagttttccaattctcatgaattctagatttatttggaattcctcagagaactctctgatcttatgaaagttttatacccacattcacatttttgtttatatagatgcattggttttttactgttccacttttcacaatttgagttctaggtattacagacacaaaatgcattcatattcaaatattgtgatggctggacatgacacaggacaatgtcacagccctcctgctcttgtactacgttgctgagggattatacacaaagctgagtcaaggtcccaactctaaactggatctgtttgctcaccttggtgataaattttcttccagtccaagtatgctgtgaattacatacatcagtccctaatttcagattcagtgggaaaaaaaacaacaacaacaaagtcacactagagtgtaaggtaaattctcctattcaaagtataattgaatacaaaataattgaatgaacgtactgagaagaacattcacctcattacaaaaatggttagtcataacagcatgttgcgtttgctgctttttctccttttggagccgtggaattatatccaagctgactcaggagtttatcaacccatcacgaggatggaggctgccatcatgaaggcacagttgactggcagcatggggaaggatggcacacagcactgcagttgggagctgggatattcctgccatggctctcagcacatagtagtgcttaatgcatattggctgataatagctaacataccgacaattgtgtaacattgagaaaattaagctcatttggctcaagttttatctggaaaataaagataatagtattagtctcatggagttgtgtggattaaatgagctaatgcacataaattacgaagcatagggcctagcatgcactgatctcaggagatcaagcataataaacttcgtagcatgtgttgaaaagaaaaaggtaggtctataagaatcttataaagtataaacactgctttccccttctattttccttgcatttggattctcaaaacatctgttgcaggagctgtgttttcctgtgctacacagagtagtagatggagaggaatagcatcggaatcattgatatggcaaactaagattcttacagccagagtatggttttctaaacttcctaatcatttcaaatacacgaatagtgactacaaagtaatgagataggtttctgtgggtggcttatgggaatcagtcttcttcacagctttttaagacagaaacatctatagatggtccaggcactgtcttagatgctggaatacaaagatgaggatatggcactcacaaaaggacactgtatgtaagtaatcacaaaacgatggagtaattgggggtgccattcacatacacaggggctccagggctaacccttgggagagtgagcagggttgtgggaaatttcacatgaaggcagtgtttgaagcaatgggaagtgtatgggggaggatacgattaaaaatacaccaagttcacagacttaaatacttacgttacttctattctgagctgtgtaatcttgagttagacattttctctctttaagccttaaacaattactgagcaaattactctgttgttagagatattaaatttatgtaaaatcagagggctggattggaagatcccaacagttcttaggtttaaaattccttttatgcctgatcatcttccaaatagtgctaaaaacaccattacacagaagatttggaatttttaagaataaaagagagaggtgtttgttcctataaatcatgaaaacttggcattggtagataaaaccagccataaataacagttttaaggtgatggggattccccaattctacttcaataatgaaagaccactgtaaatccataaagtggaaatttacaaccaactgctgagcacccgtacatctcaccctaaattttaacagctgttcccctaaaagtgatcacgattataagcagggtgaaatgtactgagcaaagtttttaaaggtataagttcatattcatgtcttcaaaatacttgcagaagttaattttttgcaggcagattacagtttacaaaaacaagtattaaccagagctgtaatcatttgtaaaactttccactacagcaatttgttaacctatatccaatttttagaatcagcaaggatgccactgttggcgtcacattccatattgcttacatttgacatgtgcctagttttatctcaaaaatggggcttcacaaatcaaatgttattttctgcacctgaaaattcaggaaccacatactactgccagcagaagcacaatgtgaaaacataagaccagcttagcagtaatcaaaagcacctgttttcacaaaatgtttgccactgttctgaaactacacataaattttaagtttgttggctagactcaatcgtgaaaagcagttcagataattatcagaaaacaggaatttcatcttacattaaatttatttttaaacataaaagtccaatcctctgaatcatatttaacacatagtaagttatgtagaaaataacttattccaacaagcaacatacaattccctgtttatctattgatagtaacataatctacaatagcaatataaagggtctaattctccacaaagcacagaagatggtgatgctgtgggctgtaacctgaaagaccctgtacaactttgtgcactttctggaaataatttctttgacatataatctttccttggacatacaaaagccattaagaatctttataatggagtgcacttgaaagactagggagaagcataaaataattttgttctacagaaaacaaacaacgactataaagcaatcatacattttagtatcctctgatgacatggtaagtgtacttttagcttaagaatcatgctcaatggatgtttaggatccaaatacagagaagattatgacacacttactaacactattctacagacagagcaaaccatcttttcatacccccaaatcaccacccccactttagacaatccctaactttgcaatagtatactaacagaagactcctctatgtgaatagcaacagcagtcctgcaaaataaaggttttctccagtaactatgtcccctttggccacagtcgtcttttacctgttagtgacatattgcaaaaagactttatgattaggcctggttttaaatctacatttttcctattctgagtgcattattcctaggaaaaaatggattcggaattaaaaaaaaaaactgatttaacaaatgaatgtcaaagaaacaagccatccagaagatggcaagggaagtactgtattagaatgaatacacttttatctctggaggctttatgccccagcctcctatccagattatacaatgactccatctcttcaatcagggtcatcccaacatcctgttctccaagaaggaacactgtatctcaaacgctcacccttctcaacacctccaccactccatcccaaaactttgatctggttttcttcattgtacttgccactagtttttctgttttctttttagcttgctgactccactagggcaaggacctcctctgtcttctgtaccacggtatctccagcatgtagaatgactcttgacacgtgcatcatcaagtaattgctgaatgaataaaaatggtgggatgcttaccacaaatacaatcttcctattcttgaaagaataaagatggtaagaagaaaattcaagcattatattttattatttacaatattattaattatgaataacttatttagtcacaatctcatactattttgagccagttcaaataatttctaaaacagaggtcttcaaaggtttggatatcaactgaaattcagctcagtttctacatatctataaacctacttgctgacgtttagtttaaatctacagatccaaataactcagtcccatggttggatgtttcagaaaagctttttggttgtaagattatgtaatagttagtgagatagtggggtagaattctaacacttcaaattttaaaaagcagattaaaaattctattatattctaatacaccactaggcatgtttccatctggcatcatggtgaatgatctggtgagaggtacatggggaagttgtgtgttccctctaaaacaagacttaactctctaaatgaaaagtaagggcaaagaatgttaaatgcactgcagttatgctgctaagcggaacgtcatctgtccaaatttgcccactagctatccccttcttccagctgtttgggatgtatgctgccctggggagacacagctctactgactacacctgccagtgattcctctctctctggggtcttcagcactctccactgggatttagaaccccattttacaaataggaaactgaagaagcatactgacccaggtgattcatccaaagtcacatagttttttagtcccattaagagaattatattttgggaggatgggaacttttatggaaagaatatagtttccatcggtggcatttattactatcaaatgaaaataactaaagaatcatattttccaaataagagcttaccaacactatcaaacttgaaactagctgatctgagttccaatctgagttctggtcctttctaattctctaacctagagaccttaaggactggaattagtgaatacaaccctgagaggagcctcttgatccttcatgtctgtctcctttggatgtgggcttgattccctcccagtccagaatggtttctccatgagcacagtgcactgagttgaatttgcaaactctcacaggagcattctgattgacctagctgtttatgaacagacaaatcactaaagactaaaacgtggtagttttctataattgtaacccaaattatcacagttttgatcaatcaataatgacagaactgaaggagaaacaggagcattttaaatatgaacattgctcttccaaggggaatgaaaaaggagttttaaggcagacaaatgatgaccactacatcatgcaaacagaaagcactagaatatgctttttattaaataaatagaagccttggtgatcttgtagaaatcaacaaaaaataagtagaaaacaagaaataaaaattaccacatggatgtgggcccaatacagagctcttctgtgtttgtatagttaaaacagaaatagcattgaaggaattactcacctccacatgccatatgttacatccgtgaaagagtaatgtgaataaaaaggaggcatgaaatcttattgcacattaaattcaatagagtctatgtttatttgggtcaagatatagattttgaacacatattgtatttcttgaaataagccagcaacttaacatataacttacaatgtatttaaaggaggcataggtttattcagtaacttgccttgtctggaaatgaacatgttcacattggaacgatttaaatgaaagctggatgtccatatagctgggatattgaagaaggaccttctatttcagatagcatgccgtactaactggactccgaagtccctcctaactctaatactgtttgaaataattatgccattttaagtcccctgaaataatattcactgatgaaggtagctatatttgcaaaccacagagcaaatgacaggtgacacagaaaatcacctatggtttttgagccaccgacaatcactttaattaacatcatctgtaaatataatatcatattaatttgacttgcagtattaaatcaggagtttgtttttgttcaggagtttaagataagatggcctactgttcaaaaaaataaagccacctatcagggaactaagtagttacaatttatatgtagatgatcctggaccttaaatatcatcagaaggctcatcagtgagctaaaacaaaagtggggatgagaggtgaaggaccagacccaataagggagtctggctgctattcccagttccacgacaatcagtggggactccgtaagttgattaacttgtttgtatatgttactttatctaaaaatatactcaggttgacaaagtagattctaaggtccctttcaactttagtatttctttattccatatagaaaaaaatatagcttgagacaagaaagttggtcatacaaaataaccagcccatggaacatgatagccaatcaattttcaacaagacaaatatactatagatggaaagcaattcttagggaagaaaaataagcagtatagtcataaaacaagcaagtttgccctatttctttataattgatgtttcttctaattcattcgggattttttgagttaaactaaatacagctaaggcttgaatcattcaggatttcacatccaagacctgtcagtctgatgatcccactatttttaacatagaaataaatggcttctatgcttgtaagcactagagaagtaaggacagcctatgaaatgtgcttccctctctccttccttttcccctccccagttccttcctcttccctgtcatcccccacagactgaggaaggcaagactccctttgattatgtgttcagctcttgcacatatttctgcacaaatcaggcatctttccaaagtatatgtcagagttctcactctagccttgtggcacacttatcaagaaagaaagtcctaattagacgtcagtttcctgaagcagagagggtgtggttacatgaatttaccaaagggggaaaactctaaaggaaccagtaagaataaattacttatctaatcacccacaccacagcctaaaaattatcattctacaaataccactgtcaatattgtttttcctctaagaagaacaatgcatcgtgtttttcaatgacatgaaagaaagtgaagcacccttttaaaatacgatttgaatatctaaggcactttaaagcctgaattgcctaactaggaattgtaaatgcatacaatgcatcataaaataatttagctaacaatgatttcatacacacacatcacaattactgctgaatatctattagaataggcaaacaacaacaacaaaacaacaaatgaaataatttgtacatacaaatgacccttttattcagaaggtctaagccatattcatgttcctccctctctccagtttccctgaaatgaccccagtaagaaaagttaattggtcactaatgactgccctgagagctttcccagacagcttttcttcaatctaggagagtcaggaagaccaagaacagcagttaccatggaggagtcccactcctaattccatactattacacaggtgtataagatgctagcgctgtacatgagagtggctcacatacctctattcataagagagaaacaaattcttctttctcaagtaattcagctgcatggacagcaagaggtcaggattgttatgtataagcacagtgttaagagattgcttctttaatatacattatctgtcttatagctggaatattatccggtgtggctaaataaaaatacacatgacaatagaatcagacattttatttttgtatgacacatgaattaacatatgacctgccagagcctataaaaagacattaccataacacagtatttagcgaaaaacaaaaacaccaaacataaaaaaatggaatgttagggtccttttctagctcttcactacattcaagtttatgacagttttgtaatcaaagcaagtttttctcaaggaaaaataccaaatgaatcatctttgtgagaatttcaaaaagtaaatggtgcttcttggtggatacgattaaataaaaaatgcagtctcggatttacaaacatcttcagaatttcaaaggtttatcaaaattctccaacactacttaatattcagtgatagattatgaccctaaagtaacaggaattctccccactgagcattcctgtcagaaaaacaattccctcaggatatttaggtgatttctttttgccttgaataccaatgaaaattctccagtcaatacctttacctaaattgttttggaaatcaagcaaagttcaaaatatatacaatatagttctataactgggaaaagctttagggacaaagccaccttgtatcacattttaaaagactaaaacccagaaatgtttggtgacttacccaaagcatgcgtctgtctagtttatttaaactctaactctagaattatgaaggatagatgagtgatgaaagcagtttttaaaaaaatcaaacatggccatctcatgtacattgacatacatcaagtcaatataaagtcagaggagatttaaaatcattctatcatcattgtcactgctaaaactgagttttgatggaatttcagaaaagtcatctattattaaaataacttcttttccatagcatttcaccctatggacattttaattcagactctggcatttaacaagattataagtgatgctgtatttaagatgaaggaatgggtggtgaaattctaaatcagaacccacaatagaagagacattaggataaaattaaatatcagaactggaaaatgtactacagggaggacagacttggagaattttctgggaggttctttttagctgactatttcattattacacatacaaagttcttgtggcaatcttctctaaaggaaaaactgacaagacagagggttaagtttctttcaagaagtaaacactctagggagaaaaagaagaatgacacttctggttcatcaatagcatcattaagatgtgaacatcatcagtaaattccaccacgttttcagccttaatgtagatagtttttctaagccgtctcgagaaacacatggggtataaacgtttaaattatgccaaaaactaattaaaacagatatgttgtagatgtaattgaatgcaaccatattacccatttgagaggactggttttaaggtcggtctcactctttaatgcttttctacagctctaagatgtaagtggatgtctcccctacccaattcagagaagccctgaaaccgaagccaaaagatgcactgagaagtcattgtattatatgacttatcttctttaaaagccctggctatttgacatttgatgaaatgccaaatcccaagtgcctgagtccactctgacacattctgtttattatgtagtagtttcaagttggggacccaatttgcaactaactccacaagttatatattacataatgggtatgttctgataaatcacaggaaaaacatgtcagtttcatatctaaaggaaatgacttttgatatttaacatcttatccttagcatggccttgacaaatgagataaaacgtgattctctttgagttatttcacttaatgtataaagactacttactatcttcattatataattgtcctaactctagtttgggaatatttcttagatacctccatatatagttcttcttgtcaagacattttataaacttacagagtaattctattgtttttaaattcttaccaaagctagtagtatgcaggcatttgagaaatattgttcaattctgtttctacaaacatatatcatggtacaaacctgagatggtatgaatctgactcagtatatattgactgcaaaaaatctgtacaatgtctaccagtctaattaaaagttcataagctccttttattcagtttctgagttttcagaattacacatgcaatctgacaatattttttgatgtgacataaattttagttaaattctaggatatagtacggaaacaaaatttaggaaacagagtgtcactctatcagaacacattattcatgtgcacacatttaaaagagaaacatctctaaaaccccgaggttactcaggtaaaagcaatacagccacattattcaagcaaatatcaaataattacaattttacattcttgtattattgccaccacatgaattttcaaccctcagtcttcatcaatcgcaacagaatttctagcatttagaaggaattctcatggctttcaataccacagaaattgggatttaaattatttattagttaatgctcagagtttataagtgggatgcattcatgattagacatcaaaagaccagaacgaattagaattgaaatataagtttataaagatccttattgaagaagacaaataaataatttttagctttttaaaaatgtagatcatacataactgtcatcttcccccatttggggcacatcataaactcagtgatctctgtgcatagctgctttctctctgcacccttaggcatttctgggcattttaaatctagtgggacaagtctaaaccttaccagaaacttaaagcgctgacagataaaagaaaactgctagttctcttctatttataagctaagtttcaaatgtctcaatatagacatattacggatactacaggtatcactgcttctagctgacagcaaataagaattaaccttatttaataacaaaattgtaaacatgcatcagagaaaggtacttgaacttccttgtacaaacaacacctgagattaatcacagataactgtctagaagtctgtatcaggagcattaagcattaacatcaacttgaacatgaacaattatttcttccaaatgagctagccttccctattctgaaagaaaaaggaaagcaacaactacaacagagcatattctggccacctactacgttggcttgcaacttttttgaatggcttattaaaataacataattaatttcacctaaaatattaacgatgtgtacagaccttggctggtgacactgtctagatgctattatctaatggctgttcttgcaacaaatcaagcaaaacatagcacttcagtacttacagactgctcacagagaacaccatctgagaaaccttttgcatttaagattaaggctccacacaaggtttattgttagccccagcatgcgagaaggaaccggaggatggagagaagcgcttacttcgaaaatgctctgaagcgtaataatagacatcctcatagccctcgtggtaatcctcttctggtcggtactttttcccctttcttctcctagatcttcttatcgccttgacaaaacccaggaagcggtccatctcttactcaccgtgcagcgcggcacagctagcacaagagcacagcaacagcccagctgctctgcgagccggtggagcatgaatgaccaataccaaacctggaccaggacagctacccttctatctacctctgggctaccatcaacacggcgactttggccatcggaggggaaagaaaataatagcgatatgggtttaccttgacaatatttctcatttagatcaataaactgtcaaatctgtaatttttttaaaaaaaaaagaggaaaagagaaagaaaatgaaatggtaataaaagactaagagaaaaaacaaacagcaaagctttggactttaaatagcttcaaaacaaagttcaagagattcagctgaggcaagaggagtcccagcacgagaatttcactatccaatatctccatcatctcatcatcggggcgggggtataggagaagggagggccggggaaacacattagtcaatggactgaaccaaagttagagactgaactgactttcctacctgctaatccaacaccctaatcctagcccacattatctcaaaacatgtgcttgggaaacctcttgaaaagctattgttttgcaatgggcgtactgattaaccctttgtgctcccttgcatatcatattaataagcagcaaagtggtttcatccatatgcacagccctcttgctgacaggagtgtgcagtatgtgttaattggagcagcagggagaaggctcagcagctgctttcaaatgacacgtttacccactgggcattaatgtattccaatcactgtttgatttaaatattaaaatgcacttcacagagaagcttctcataggcttagtaacagcataccataatcagcaaataaaggaaactgcctggtttaagggaaaagaaatacaaataatccaactcaacttagactgaactcaaatataaacctagctcaattgttacatttttaaaaaaacatgaaagtaaatgggctaaacagcaaacaaaacttaattcttcttggtgaagacagtggaaagagaaatttcataatatgctcacatgctgttcatcctttatctctaaaaatcacaagctttaaaaaattatttttaagaaccacaatcagaaacacttcatagtagacgagagaggtactctaaagtctagagaggtcagcattaatcatgaataatttttttttctctatagcttctttcttcttcaggtctttaagcgaaagagaacttttaacaccaggaaaaatctgatttgtttacaatataattaatcaagcatgtcagcatattacctatgaaactaatgatatactgcagctccatgttcccagaaatataatttttaaaaagccttcttactgaataaagatagttcaatatctgtgtaatgtcaagtttgtaggatcatcccagagggaactgactgcactttgcactctctgttagattcacaagcaatttgtctgtcttctagatttacacagttccctattttcagatataaattgataatgatggagcagggagaaatttacttagaaaggcaaatattcatcagccaagaacatatcacatctaaaatatgtagttactttcaatggttctgtgaagttcctttattcccagaagtttcccattttgtatgccttaggagtaagtttgtggaaagaaacactaacttaatgatgctgacaaaaagatgctataaaatgttttatgaacatctttaaattaaaaaaatcacttgtccttaggtttcttttttttttcttttttttttttttggtttcaaatcctttattattctgattccctcaaccaaaacaaactagaacaattaacaaataatgaatgagaaatttgaagatctggattttagacctgaatagtcactaaatatatgacaataataatacacaatcttttaatttaacctaacagctctaataatgaggtgaatgtcattatacctctatggatgagcaaaaaaaggttcaatggtgttttagtggtttgtccaagatcacaaagctaatattatcatggcaggtagtagcaggtatttttcataccagttcagagattattttgtctatctaagaattacatgcattcaagttcattcttttctatgtaaattttctcttgaaatggaatttgaaaaaattgtcaactttcatttttaatggaccaaacatatatcttggtttatgtgattaattcaagtatatgtgtcccccagagataatgcaggcaataaattttacgcaactacacttgaattttaactcttaaattagtagagtccatattaagttttgtagttttaagctcccagttcaatctaaaaggactaacttacagaagagatggtgctttactctttaatacaaagaagatcccttttgcatagaacaacttaaaacatttcactagagtttgattttttaattttggtatttaaagggactgattttctcaagcagtggtaagcaactatttttgcacaagaactaatgcagacaaagtaaaattatctacataccaaactctgttttcagaaataaacagaaattgtacataagcacctattttttttttttttacttctgaaggattacatttgttaacatttcagtatctgtaatgatagaatttttatatgagatgtggtttggtggtgctggggaggaggagttcagagtttagccatatatttgaaggcatacagcagaaggtgtaaaagctcattacaacaatcagagatgcttgggaagccaggataaggaagctgttatttaggggaggtccacttgggtcacagagaatgaaaggatgttgtaacagatgatgtgaaggagggaaagcatgagtatatgggccacaatctgaaagacagaagactagacaccgggtgctctgcctgaggggtggcggaggtaaacgagatcattttattcaattttcctgggtccatatttcttgatatggtttatatctgtgtccccaccaaatctcatgtcaaactgtaatccctagcactggaggtggggtctggtgagaggtaactggatcatggagatggattttccatgaatggtttagtaccatccccttggtactattctctcagcagtgagtgagttctcatgagatgtggcccgttaaaaatgtgtggcacctggccaggcgcggtggctcacgcctgtaatctctgcactttgggaggccgaggcaggtggatcaaaaggtcaggagatcgagaccatcctggctaacacggtgaaaccctgtctctactgaaaatacaaaaaaattagccaggcatggtggcgggcgcctgtagtcccagctactcgggaggctgaggcaagagaatggcgtgaacctgggaggtggagcttgcagtgagtagagaccccgccactgcactccagcctgggcgatggagtaaaaaagtgtggcaccttccccctctctctcttgctcctgctctggtcaagtgagatgctcactccccctttgcctttcaccatgactggaagcttcctgaggcctccccagaaatagatgccgctatgcttcctttacagcctgtagaactatgagccaattaaacctattttttatacataacccagtctcaggtatttctttatagcaatgtgagaacggactaatacacttctgaattttttcccatcttctgcactaaaatgatccatgtttagcaataaagggccaacctaaagccctttgtcaattcttggttgtattataatagctaactgttgtttaacaattgcttaacagttagctattataatacaaccaagaactgacagattagtagtgtagttcaagtccattcaattaggtgtaccactctttgcgtagagagaatggccctttcactccataccacaaactccagtaagaggtgctatttatcagttattgcactctatagtctaaactgatgggacagttgagaagttgcaaatggcagttcacagaatggcagtttatctcccacaaatacattttgtttggctcacatgaatgtttgtggttttgttcttggttttttgtttttttgtttttttggagacagactctagctcggtcacccagggtggagtgcagtagcacgatctcggctcactgcaacctcttcctcccaggttcaagcgattctcctgcctcagcctcccgagtagctaggattacaggcgcctgccaccatgtccagctactttttgtgttttgtttgtttgtttgtttgtttgagacgggttttcactgatctcaaactcctgaccttgtgatctgcccacctcggcctcccaaagtgctgggattaaaagcatgagccactgtttttctgttttgttttgtttttttttaaactgagcaaacatctaaagtcaagagatttcataaataaatcaaacgtttgtttttgtcttgaaatagcaaaagatttggtaaccttgagcctgattccaatatggcaactattgattagagctgagtggtggctgcctgccacccataaataaacatgtgctttccatttagctagagtccctccccagggtccaattcaatcattcagttaccacctggcccctgcaggcataaatgttgtgaacaatggttgaagtactatcctgactagccagtctcaaaacactaattactttaaaagaaattccagcacccctatattttgatgtaaagaaagcaggctattataataaattggttatcagttgagctaaatgttcactaaactataatattaaatttattagaaaaattcgttcacatgagaaaataaagcagtttgaagtattcaacaaaatgcatttcaaccagcaagggcaaatatatgttaacaaatatgtatttttcaagtactaattattttcttttttgggaagtaggcaattgcctatatagcatttacatgatttccgtactcttctgaactggattcttcatccccttttaggaaaaaagaaatggaccagctattgagattaaatcttcaatttataacctttcctagatcagcgattagggggttcccttcaatgcataattaaattgagtaatggttatagtattttttttgagtaacagtatgaaacacacagtctataagagaaatctttaagacattaaattaatctggcccttttagatttcatagcatctgcacgcaatgccaataatcgctgcagccttcatgtagccttgggagagataccctgacctactgaggatgagaatgggaaagaaaaaaacactctgttctctggcactaatggtattctcattagacccactcctactttattgtagcaaatgatttgtaatatcccttcttactaactgaaactcatagatcatgtaactcatgagcacataatttaaacacaaaatgtctttttttttttttttgagacagaatcttggtgtgttgcccaggctggagtccagtggtgcaatcacagctcactacagcctccacctctcagggtcaagcgatcctcccacctcagcctcctgagtagctcggactacaggcatgtctcaccacatacagctaatttttgttttgttttgagacagacagggtttcaccatctggctgatcttgaactccggagctccagcaatctgcccaccttggcctcccaaagtgctgggattacaggcatgagccaccacacctggcttaaacacaaaatgtcttaatgctgatatatatatttaataatacatatttcaaataaatggatctgagggcattgctacaacagaaaatatagttaaatccttgcaaccacttctaatgaataattctgaatttgagaggggatcagaagccattccatacatcatacagaaaataaaaaggtagacaggtagatatcagaataaaaaccagtatattcactgtacactaaaactgaaaaatacttcatgtctgtataacagtattagcttctaggctcaaataattataaatagattttcatttataagagtttttattggccaggcatggtggctcacagctgtaatgccagcactttgggaggccaaggcgggtggatcacctgagttcaggagtttgagaccagcctggccaacatggtgaaaccccgtctctactaaaaatacaaaaactagccaggtgtggtggtgcgtgcctgtaatcccagctactcgggaggcttaggcagcagaatcgcttgaacctgggaggcagaggttgcagtgagcgagatcacgccactgcactccagcctgggcaatgagagtgaaaccctgtgtcaaggaaaaaaaagagtttttactgataatagttatgtgaggtagataggatgcagaataaattttccgtttgtaaccacgtctccctcattttaatatttctagcactttcagccaccatccacgaaatgctagcaataatccccaatccccagcattgtgataacccaaaatacagaaaaaaatacttactatgtttaaaagactttttccacaaataattcttaattgggtctctaatttgattctgtccaatttctacttatttgtgttgtttattaaagcatagagccacctgcctaaacagtgataatataccctaagtttgctcatctgcaaattggtgaataaattaagccaattcatccatctgtgagctatttcaaggtcgaccctccattggctacaagattttgagttaaaaagacagtggaggacagtgcttacagtttgataatgtttgcttactgagcatgaaatgaaatttaactgtggcatgtctgcatttgtaaatttattgtggttgtttagacttcttgcaaaatgaaatgtcaggcagtcattctgagactgcaaatatattaggcttcaaagggctcagataactgaggttattgagttttcaaagatttttttctactttttttctaccatatagaatatgttcattcaataagtgtagaatgagcataaaagagcaaaagcataaaaataatttctgaatgtaaaatgctaagtgtgccgttctgactattataaggatttcaaaaatgttcattgtatcggaactcattttttcctgaaggtgtatgtgtcttaggaggaaagagttggactagaaagtctcttctagctacaagatgttatttttatgcagctagatgctttgaagtgatgaaaaatatagtgctaattatagtgtcttttaaggtaattgtgagacttcacggaatctatttaagctcaatgtttgatggttctgaagaatatattacctaatgccttctatttcccggaattcattccattttccttgtctctctctgattctctctctctctctgactctctcctctcttcctccttccctccctccttcccttctttctccttgccaacttgttcttttcaagctacttggagataagaaaagtctacttactttaagttatacatatttatttatttatatttgtctcttggttggttggtttttacccaagtactgaatttctaaaagctgagaattttatttattcatttggctacaggaacattttcttggtatttaaatttgttcctgtggtctcacttctaagctgtcataaataatctaatttaaatttctcttcttttccgtctctaaatgcattgccatgtgattcatctttcctgccttctcggcctttttctcttaaagccatttctttggcccccaatcctagctatgatttacaagcaaacttatttgggttaatagcaagtattttaaagcacttgtgagttttagattttttaacagccatttatccaatttgagttatccagcatttctgcctctcctttttacttttatttatttatttattcattttgcgatggagtatcactctgtcactcaggctggaatggagtggcgcaatcttggctcactgcaacttccacttcccgggttcaagcaattctccagcctcagcctcctgagtagctgggattacaggcacccaccaccatgcttggctaattttttgtatttttagtagagatggggtttcaccatgttagtccagctggtcttgaactcctgacctcaagtgatccgcctgcctcggcctcccgaagtgctgggattataggtgtgagccactgtgcctggcctcctctttacttttattattgagcatttatctggttcattcgtctgtttgttcatttatttactcaattgttcttcacacacataattacatgttcgatatttattatgcggtaggtgtgaaacagaatatggagggaaaattctaagtcatcattcgccttgatagtagctttagttacaagttcaagtaaagagtttaaaactgttagcttaaattacacttttagaatgtctacagctctaaggattcatttttttgccctataaaatgtatttagtgccagtcacatgctagatgtttaatccatgatggctttgaccaacttttagaactggtcctatttcacattcttgctggttgattttggtgtttgacatactttttaggaggaaaacattaaaggcccttgaataatttaaacagtatgtttccatgaactatgaagaatatgtgcttgtctcacactaaatctgattcatttattcgacaaatgcttcctgtgtgtctctagtgccaggcactattcacactctaaagatagaacagtgcatatgagggtaacactcctctcatggagctatattatagatgaggaggtgtgttagtctgtttgtgttactataaaggaatacctgagactgggtaatttataaagaaaagaggattattttggttcacggttccctaggctgtacaggaaatgtggtaaaggcatctgcttctggtgaaggcctcagggagcttatgattatggcagaaggtaaaggggaagcaagtatatcacacagtgagaaaggaagcaagagagaggaaaaggtgccgggctccttgtaaataaccagctctcatgtgaactaatagagagagaactcactcatcaccaaagaatgacactaagccattcaagagagatctgcaccgatgatccaaggacctccactaggccccacctccaacactggggatcacatttcaacatgaggtttggaggggagacacatcaaaccatatcagaggaaacagataacatacagtaaatacatcatcaaagtaatttccaatggtgagaagtgacaaggtgatgcaatggaagtgactctgggggctatatttgaatggggagagctgagaaaacattaccaggaggagacacaacttgagcaaagacctaaaaaatacaagaagatccattcaaccaaaggtgtgggggcagtacctttgatacagcatgaacaggaaggatgacaatactgagttggcattgtgccagggacaggaaggtgaccactgtggagaataataggagaggaagctaaagaggcagacaggggccagctcacctcaggctttccaggcccagatacaaattgtgggcttctattccacatgcattaggagcacatagaactcagtgcacagtgttaaatagggaagtgacatgatctacatttaagatgaatattctggttgtttatggaaaatgggcaagagtggaaatagggttctcagaaagaaatcaagcatgattctttgacttttggtgtgaataactggaaggataatactgtgatagtattactatgataggaataatggtggagatacaggtttaagggttgtgccttaaactattgtctatattatgtgtatatactttatatatagttataaattttatatatagttacatactttatatatagttataaatctatgaattttattttagaagtaaatgtaccaccttcagctgtgcaactgtgagcaagttaaactctctgtaccccatttcctcatctacaaatgaggataaacaatagtaccatattcataggattgctgtgagtattaaatgagtacatgaagctcttggagattggtacatagcaagaaaaatttaaatgtattgttattgataataagggttaatttactgaaaggagccttcttttcattttcattcactttattatagctgcttcttatgaaaccttgtaattatctgcttatttaactgtgagttcaaggtagaactgtcctttttattgttacattccgatagtctaacatatatttgtccctttattaattcaacaaagaatttactgaatacttattatgtgtccagctgcactaagtactagtgataccataaaaaaaaaaaaaaaaagcaatgaccatgtcttaatgaagcttacattctggggggagaatgagtttatagaaaaattaaataaataaatcaataaggtatatgcattagttctgtcacactgctatgaagaaatacccgagactatagtttatatttaacaaagagagagagagagaggtttaattgactcagttctgcatcgctgaggaggcctcaggaaactttcaatcatggcaaaaggcaaagggaccttcttcacagggcagcaggatggagtgagtgtaaccaggggaaatgccagacacttataaaaccatcagatctcatgtaaactcactcactatcacaagaacagcatggggaaaccactcccatgatccaattacctccacctggtcctgcggttgacaaatagggattatagggattacaattcgagatgagattttgggtgggggatagccaaactatatcagcagatccatattagatatttatatcctttatatgcatataggaagcgtttcatacaaatttgttttgtttaaggaataaagcaattactatgtaactagatcttctcctggaatattaccaacaaaggacaagtcaaatctcatgacgaggtagcacattagtgactctcatggatgagggtggtatcataagaggggagagtcagaatcacctggggaagagttttttccaaatcacaatgatcctccaaaacctagctcaggaactccatttttcagaaaactctgcctgatgatcacctcccccatgccttccaaggggtctaggcctgagacttacagcatctaaggatgactctattagtttggatactagttcaggtgctttaacaaattagtaagagtggcttacactgagcacagtgactcatgcctacaatcccagcactttgggaggctggggtgagtggattacttgagcccaggagttcaagaccagcctgggcaacatagtgagaccccatctctacaaaaaataaaagaaaaattagccaggctttgtggcacacgcctgtggttctagctacttgggaggctaaagtgggaggattgcttcagctcgggaagtagaggctgcaataagccaagatcatgctgctgcactccagcctgggcaacagaataagaccccgactcaaaccaaacaaacaaacaaacaaaaaaaatggggagtggcttaaacaagatgaaagatttctttctttctttctttctttctttctttctttctctctctctctctctctctctctctttctttctttctcatattaaggtctgagtggtgggagagaggaggttgaactgttacatgaggtcatccagggatctgggttccttctgtctgaaacatgataacaagaaatattgtccttatattcatgagtgtgactcaatactgtcatggccaagttctagcacaaaggaagagaaaaaatagtaaatttttcatctgagaacaggatcagtaagttgcacctgtcacttctgtgtagatgtcattgtcttttggtcacaccttactgaattggaagaagggaaatgtggtttctctaaatttgagagtttctattagcaaagaatgggtaaatagacccactggaggacaattatttgtctcccctcacttactttattgcagcactattattctctgttgttattaagaccattttggctttccctgaaactgatctccaagcttgctcagcaaagagccagtattttattcatgtttgtttccctggtaccttgcatagagcttggcctctgataggcactcagttcctgtatattgattgtactaaaggctctatcaaaatttaattttcttctcacaacaacctagtaaggtaaccataataatctcattttacaggtgctgatatttataaacttatccattaaagattcaataaattatggacacattatttgtaaccaaccttatgtaagtcctctaagtccttactctttcactaaaccacactggtacattttaagaaaacacaaaaacttgagactaccattttaaaatatagcctcaaaaccttaaagaagtattagaattttcagatgactaacagccttctttttatcctatatcaatgaaaattttctgaatgacaagaaacaagaattctaacagtagactttgaacttcttacagaatcttaaagtcattttgaaaaaaacaaaactagatcctcagtcccatttgctcatgaaatatgttcatatatttgcttcatgattaaggttgccccctttatattttatactagagaactgtggggtttataacattttaacctactcaaggcactagatcttcaaaacaaaatgtaaataaagcagtattcgcaaaagacgattcctcatgaacatcctttcctcagaaaacaaataagattttatccaagagcctgagaaataccaagtcaaacaaaattaagcctgtttttcaactgtaagacttctaagtgcttttatgacactcttatgccagtatgactctctgacaggcagcaaacttgtttcatcacagtatatatatatacataattttcagtatgcacacacacacacacacacacacacacacacacacacacacatatatatttcccacggactatttcattttaaagcgtaaattttaaatttggtctcaagacccatctgctctttaaaaaattactgaggacatcaaagagcttttgtttatatgaattttacttattgatatgtaccatatttgacactaaaactgaaaattttattgtattttttactttttgggatggagtctttctcttgtcacccaggctggagtgcagtgacatgatctcagctcaccataacctccgcctcccagattcaagcaattcttttgtctcagcctcccgagtagctgggattacaggcacctgccaccatgcctggctaattttgtatttttagtagagacggggtttcaccatgttggtcaggctggctggtctcgaactcctgacctcgggtgatccacccacctcggcctcccaaagtactgagattacaggcatgagccaccatgcctagcctgagaattttaaaatatgtttattactaatttattaagcaacaaatacatcacatgttaatataagtcaaatattttatgaaaaataactacatttctcaaattaaaaaatgcctaagacaggcattgttttatatttttacttaatctgttctatatgtagcttaataggaagaagctacattttaatgtcagattctacattcgatctgttgcaatatgttatttgaacagagtatagaaagaaaatctgaaatgtagttggaaaaggaaggagtattttaacagccttttcagataattgtggatattctttgatactataccaggattcaacattaaatattagttataatgtggatctgaaactatgtcaaggaactgtttgtactctatcacattaatatcagttgttctttcttacatctagaatatatcttgacacatcatgcatttgttagttggaaaatattggttcactgagttatgcaggtcttccaaatgttaatacatttcatgtttcattatacaatatcaaaacatcacattcattatctccacaaatctcatccaaaaagtcagtaagtatattaggaagctgccaagttcataatggtagatacaagttttccaaagttccaattttcacttaaaagcttgtattttattattggcaacaaatgttatctgttatccttgaagtaacaaatgaattcatcttgttcatttttgagaaaatgtctgccaaatacccaagtctgaataactacaatttgcctgttcattctttcaataaaaatattattccattgaaaaagtagctaattcagttcacaactcaaacatttcattaagtgtttttttggatacagtcatagtactttggtatgcaacagagtgctttaaaagtacgtcccattttgttaacacagaatattaaaaagatatttattatttctttaaaggcattcataggtgaaatctgctttttgtttttaattgcatgtgtgtggtggcaaagaatatactactactactagtaaaccttggtgccactgtttgggtactaaagctccagaggtgttacccactattgtgtaagctcaaataacatggacccccaggggtccatagactatactttgagatccactgctgtacagaaccactaatgagtaaaaatagagaagagccttggtttactgttattttctgcaaattctaataaaaggtgtcccaaaaaatcttaatgcaatttaaagctttaataatttcagaagtacaaatactaacaatgtacttaaatgtcttttacatgtatttagtttagtgcatttgggaggataaaattttattttaacatttttgtttcccagtattcccaaatggactgccaaagaagccctttgcctggtgacctcagtcacctgatctgcctctattacacttttggtaggtaatatccaaaccgatgtatatttcaaaaccttttacttttgttgattttaaagctagaataatgaattcaatcctttcagctaataagctcagtagatggaaatttttacaaagttttaaaatcaactagagcaatataatcacataagatggtagttatgttgaactgtaataagaaatattaatgttttaaaatgttaagtaattttcaaatgctgttttctgtaagtaattacactatattattcttaggttactggtgtcacaggaaatcatgatacaaatacatgaattaaaccattgcctaacgttaataaatatttattgaactactattatgtaccaggaattgggctaggcacagcaaaacatacagcaaaatttttaaataatatgcattgctacattaaaccacttttataatgccagtacaaggtgggttttagttttatatgtcaaaaggtctaactaaactgataattttgaatagttactgtcaacattcaaactaagagttccagtttccagttcagcatctaaggagcatgagcatcactactctatcctaataacaagtgaaaggctaacaaactgaatcaacaactcttcttgaacccatcagagatgtgatatcatagggcaaaccactgcccacaaaattgaagacacaaacaggtgaatcagagaatcactactcttactggaatggaaaccaaagcataaatttctgtgggaactgatgctgggctaggaaagcctgtgctgcaattgatgaatttctggagtgtagataagcctgaaagataaaaactccagggagactcagttatctggaggcaccttactttagtgagctttacctcctgaaacctgctgaggttctcacagtgaatactgaagaaatatctcctcctgcttttggcaggaagagggaaaaataaccattttgaaatacgctgggctgggcacggtggctcacgcctgtaatcccagcactttggaaggccgaggtgggcatatcacgaggtcaggtgatcaagaccatcctggctaacacggtggtaaataagcatgtgaaaagatgctccaagtcatatgcgattagagaaatgcaaattaaaatagcaataagaaagcactacacacctattaaaatgtctagtgtccacaacactggcaataccaaatgctggtgaggatgtggagcagcaggaactctcattcattgctgatgggaatgcaaaatggtacagctacttgggaagacaatttggcagtttcttagacaactaaatattctctcttagtattcagtccagcaatcatgctcattggtatttacctaaaggtattaaaaattatgtccatgtacaaacctgcacatggatgtttatgtcagctttgttcataattgccaaaatttggaagcaaccaatatgtctttcagtaggtgactagataactaaactatggtacattcagatactggaatattatttagcaccaaaaaaaatgagctaccaagccatgaaaagaaatgaaggaaaattcaatgctattactaagtgaaagaagccaatccaaaaagactacatagtatgattctaactgtatgacatttgggaaaaggaaaaactagggagacaattaaaaaaaaaaaacaggggttgctagtaatcagaaggaggggtggataaataggtgaagcacaaaggatttttaggacactgggattattctgtgtgataccataatggtgcatacgtcattatacatttctcaaaatctatagaacatacaacaccaagagtgaaccttaacataaactatggactttgggagataatgatatgtcagtataggttcctcaattgtaacaactgtaccactttggtggaggatgttgataatggagaatgttgtatatctatagggaggttagggatacatgggaactctgtgctttctgatcaattttgttatgaaccaaagctactccaaaatataaattctatttaaagaaaaaaaatcaacctagcccttttctagtatatatagtaaaattataaacttggtagagacaagttagcaaatttagaaaattttatttaacattgttttttagatttaccattaatgagtgctatgaaaatggagctaaatattttgtatcacagcaaaaatgtggaaagctatggatgactaaagatcttcataactgttatatctttatgttaccatgagtactcaagtccaaaacaccctgacatgcataatcgtggtttccccctaacatcttgctttgtgatgtaagaaataaagaatacttctttagatttctagcttaggttgagaaaaggttaaacagatgtcaagctgcaaagataaaaaaaagtccttgtcaatgcaatttagttgaagtttatattttaatttttagtggcattaattagtctccctagagaaatcgagccaatagtaactataaatctctcttatacatactcacacttctgggttttggaaacaaaccattgagatcaccagcaactcctttcttaagtagtcttgtagaaggaagtgacttaggaggaaaaggagtggaactgaataagagatttggactttcatcagaatagggatggtgattctgtatacatttcatcacacaacaaaaagtagaggccctactgcgatcaagtcatatctaataggggttttgagtgtcacatccttggccgactacattatctcaggaagagctcctagatgatgagcataccttggaccagaaatagaataggggccaagtgatggagccacttccatcttgtgtgtgtgtgtgtgtgtgtgtatgtgtatgtgtgtatgtgtgtttctttcttttcaattacctggtattcagaaagcatcatgcagttgaaacattcaggtgagctaggaagaaaggaaagagctgactgtgagaagcttataaaagcccagaagccatattgcaacacacgtagaagcagaatccctggtagaaggtggcttcgccaatctgtcttcttattttcacctatgttttatgactaacagaaccatatactttctcagcatacttgtgaaaaattccaaaactcagcatgccattccttttataaagccaaaacaagattattaaaaagttgaaaaacaatacatgctggcaaggctgcagagaaaagggaatgcttattcattgctggtaggattgcaaattagttcagccaccattggaagcagtttggagatttctcaaagaacttaaagcaaaactgccttttgacccggcaatcccattacttggtatatatccaaaagaaaataaattattccatcaaaaagacacatgaactcatatgtttgtcacagcacttattaacaatagcaaagacatggaatcaacctaggtgcccattaacaatggactggataaagaaaatgtggtacctatacaccatggaatactatgcagccataaaaaaaccaaaatgatgtcctttgcagcaacatggatacagctggaggccattatcttaagcaaaataacacaggatcagaacatcaaatactgttatgttctcacttataagtggaagcagaacattgggtacacatggacataaggatggaaacgggggaggagaaagggaaaggagcaaaggtcaaaaaactgttgggtactatcctcatacctggctgatgagatcaatcataccccaaacctgagcatcacatgatatgcccacgtaacaagcttgcacatgcactccctgaatctaaaataaaagttaaaattataaaaatagattaactaaaataaagccaaagctagtaacacagaaataggtcttcaactgaaaacagacctagtaattagttccagcaaaccctactaactgcatgaccttgtgcaacttaacctctctagacttgttttctgatctataaaatgaggggattgcacaatatgatagcttatgtgtttggaagctctaaaattctataattatctgattacataatcctcagacatgtaaatatcttgaatatcaaaatttcctaggaaattaagatagcattgtaaagaactgtttttttataattatgtgttatttggtacatgttggtaatggttctcaagttgctgcctttgtatttgttttgggagattaaaattccttgaggatagagatctctagatttctatttggttgattacccaataatgtctagcaaagtactttgcacattaacattttcatgataaaaatgatcaatgatcatttacagcttccttggtttattaaaacaattaagattcatctttctccttcatcagtatttagtacatactctggcacctaatacaccatatctatctctatagcagaaaaattaagattttgtactttgataaaaaaaatcagagacatttaatagaagcaatattggaaatcaagaatttactcagtaaacaccaaccataataccaggaaatcatttctctatacaaatgatttcccaggcctgagaatcctagcacttacaccactcacagaattcaaggaaagaaagagttctgatttggggtgacagcatcatcctctttgcctttctctcccacaatataatcccaacagataaccacacgctttttactgtcatgtttgggctaaaattcttatcaattgaacaagatgtaaaacagaaaatccaatgccatcctcaaactctgaaacagacagcctgatgattctgaagtgtaaccagttctaactctattaatagctctatcctttccaggagagtacacagaaacaggctgcagctgccacaaggccctaatgtttcattctttgtacaagtctgacaagttttcaagtttaatagcattagcaatgatgtgatgtaaccgtggcagaggtagcctgagtctgccaggatttttgaaaaggtgggtggggcacaatccctaaacacctaatggtttgggataaggcattttaatcatttaaccaaaaaaatcagacatactaacaaccctccccatcaaggtggagtgcaaagaagcagtagttactggttgaaaggtggacggtttcagatatatgtgaataaagacatagcctgtgctgttgaagctccaggcccaggtcatgcgtctacactaggactgcctcatatgatgagtcattccttgcatggcactggataattactccatgcctgaagcattttactgggtctttttgatgtgacatagctcagaggattttacagggctttggcaacgcaaatggcctactcatcatgaagcccaaacaccacctccctccccaccaagccgaatgccctttgcataacctggacaagtggttgtccatttctccttcaatgtgtctattgatgagaaggtcacacatttaaataactgtggtttatatagaggaagcacagggaaactcatgattcaaggataattataaccaagaaaaggccactcgaagtgaattcacttagaagctaaatttcatagttcagagcagaaataagaaggctagaaaaatgaacaaaaatgaatactatattgacttttatctttttttaagagggggcataatttttttaaattactggaaatgtatatgatagcacaaaatcatataataaaaaatttaacatcctttacttcatgttggactttcattagcttagtctaaaagaggccattttggtaaaagtttccaagagcttttttttccccaaagccctctcttaatcccttgataaacaaatcattctcttttgacatgtttatagtaccactattgtctacttttcatcttcaatttttaactagtccaattctgtccttatatttgagcagtctgtctgcatctcatcaatctcattaaactgaacctttctgcaagattttcaatttacactattcttcattgccaagaagagtaatcagtaatagcatgtatttgtggcctttcctaacaattcatagggtcaaattttaaagtagttagtttataagcaaattttttcatgccataaaaatttttgcttcgtaattcatttaatagagatttccacatcgtcattattacctttctccatatgactttacacaaaaggcatgagaggttaaatacaaagtctgccaatatcacgcatgatcatattatttcgtacaaagggcattagctgccttctcaccagggaaagtagtttgatatagatatgccttcatcttatccttagggattagtaagtataaaatcttaggttcactttgggtgccatcctactttgcccaatgactatatctgagacttcaggcaaggcacttaacctgtttatcccacagttcccttatctgtaaaatgggcataatatagtaccttcatccctagctgcttccaggattaaatgaatgtacagtgcctggcaagtaatcagcacctaacaaatgtcagcttttcctctgctgctgctcttattgtaatagaatgatgagagtgccctttgaatgactaatagcaaagttcttccttttcagggcataaaactacattttaaaatgctgaatgcatcctatatcaatggaataaaatttttgattaaggactggaatactttgacactgttgttgggagttaaattagttcaaccgttgtggaagacagtgtggtgattcttcaaggatctagaaccagaaataccatttgacacagcaatctcattactggatatatacccaaaggattataaatcattctactataaagacagaggcacacatatgtttattgcagcactgttcacaatagcaaagacttggaaccaactgaaatgcccatcaatgatagtctggataaagaaaatgtggcacatatacaccatggaatactatgcagccataaaaaaggatgggttcaggcaggggacatggaagaagctggaaaccatcattctcagcaaactaatgcacgaacagaaaaccaaacacctcatgttctcactcataagtgggagttgaacaatgagaacacatggacacagggaggggaacatcacacactggggcctgtcaggggatgcggggataggggagggatagcattagaagaaatacctaatgtagatgacgggttgatgggtgcagcaaaccaccatggcacgtgtatatctatgttataaacctgcatgttctgcacatgtatcccagaacttaaagtataaaaaaaagaaagaaagaaaccaagtcttcaactactactcagagtttctatgatcccaaaatacttacaaagaattaggcagattgaactgaacagtaagcaaaatgttattttatggtaattgaatctaagttctatttctacttcaagtgctgctggaattagagattcaaacatcatctagagaaatctctattctacataaattagatgaaaataaactcatgaaaaagaaaataaacaatatattaaattctagtcaatgaaaaaatgagtgaaaaaggagtaacttttcctccaaagcacaaaattctaaatgccattaaactgaattaaaattggagtgaaggcaggaagaattctcacatcctaaatagatcacaggctcaattcctcttcttttctaaatactcactaggtatattctgtatgtatgtttttttaaaaaatgcatcaaagagagtattggtagagggaaatcaataatatacatccaaatatgagaatatttaatatttttcaaagcagcagcttgcctaatgtctaagatttctctctctttcttccttgaagtcaacttttggaggtagaaagaaaaattcaaatcattgtattagcatcttttgtcacataaaaatattactaaaatttagtggcttacaactatacacattaattttctcccagtttctgtgggtccggagtcttgacaaggctcagcaaggttctctttgtcggatctctcaaggctgccatcgaggggccacctgggctgagttctcatctgaaactcaactagggaaagagtctacctctaagcatactcagaatgtttgcagggcttcagtttcttactggctattggctggggcttgcccttagtttgtagaggttgctcacttactcaaaaccaggtgtgtgtgtgtgtgtgtgtgtgtgagagagagagagagagagagagagagagcgcacaagacagcgagagcaagagagtgccaaaaggacagacactacaaatttatacactaatcacataattaggtagatgtaatcacatatatcctctcacctttgccctgttccattggttggaagcaagtcacaggtgctatccacactcaaggggaggggatcacacaagggcatgaatgccaggagacaggtgctatgcaggccaccttaagagtctgtatgcaacactcatctattttaatgcttagaagattcaactttagtgcaagaatgacaatgttgatttgaaaaacatgaaaaaaattctcccttccacatttgccttttttccctacctcagtaaacaagcactggctcttttgaggtatcattttgaaattactgcaaaaattagatagacatgtgtctataattcaaacttaaaaataaattctttttcataaaaacatatcttgcttatagggccactaccgaataagtgtgtcaagttctagttttcttagtgcttcattggtggttggaagctgctgagaagaaagtacgacactgtctttccatggttctttcactgcagcctcccacaggaaggagatacacatcactgtcaaatcctggacttgccctaatttggggactcccatgcctcagggtccaaaatggaccaaatactagtcccaagatgacataaattaccagctttgtggtgaggcaattattttatcttaatttaacattcacacactaccttttctacaggctttaataaattatagaattgcaggccttgtgaattttagatataatcataactatagatgatgccatatgtgatagtattaggttaaagagagcaagagactgccaaaggctaaactaaaaaaattaaaactaatgaataggcatgatacttggaattgttgacactgagttcacctttcaaattttaaggccacatcatccatttattttctaccctactgccatacagtacttcaataatatgatttgaagattactagtagtattatgaaccaacagctcacattccctatcacttttacattttcaaaacacatttataactgttatctcattttagaaaagtaaaaatagaatcaagtatgattaactcccatcatttttcaatagacattttaggtaagtaaaaatggaatcaagtacgatttaccctcatcatttttcagtctttcttataaagaaagttttatctttcttttgcaatagacatattaatattaacaccttcccttcaaaattcagctccaactccttggtcaggcgaggaggccttctgagagtcgcactatacttgctgccatatccctctgcagacttagttgttttcaagtgtgttttatctttcatttgcttgatgagaatctcattaagggaagggatttaacttatgtttatttttgttggtattgctcctgtaatgcctcataagtgctgttgttcatagaagcattcaacaaagacagccaatggtccgacatttagccactgattgaaggatctttatcatttcagagagacttctctttataccctagaggcagactgaaaaaatgcccacctccccaggatgaattcacttctgaatccccagaacccgtaaatattatcttttatggcaaaagagtgactattaccatatatggcagaagagtgactatgacctcttacatgatcttgagaaaaggagcttgtcttgaactatccaggtagaccctaaatgcaatcacacatattcttgtgagaaagtggcagaggaagttctaaagcacagacccacaaaagaggaggagaaaatctgtacatgagggtagagactggagtgacatggccacaagtcagggaatgccagcagccatcaaaaactgggaagggaaagggacagattcttccctaaagcccccacaggaaatgggaccctgctgacactttgaggtcagctccatgaaactgagtttggatttctgacatccagaactctaagagaaacaataaaatttgtgttattttaagccaccaagcttgtggtaataacacgacagccacaggaaactaatacaagcccctaacccttgatccttcctttctccaatcaaaaacaggaaaagacactgtgtctctccctccactacccacttgcccccaaatctagttaaattttgtctccatgatgaatgtttttgtccaataagaaaaaaatatctttgtagtagattcccatttgtgtggcattttatagctcaagcgctttcccaaaccatttgatccttcaaccatactgtgaggtaaacagggcaagtactattacctctcagtttcaggttaggaaagcctgcagagagaataagtcaccctaagttcacagagctggttaggaaaggaaactaagacttcctgaggcagccacagtctcatcataacattgtgaggtagagctcactgttttacagatgtggaaactgggcctcagagagggcaagttacttgtccaaagtaaaacaggcagtaagtaaagggatacctgggtctatttcccaagcccatgagctttccacataccatgctgcaggctagaatacagccaggttattgccataatgaaaatatactagaacaataatcacatagctagtatgtgcttggcccttataacacatcagataccattttaaatgtgtcatatccactaacatgttagtccctgcaacaacttatcaggtggagactattagttattgtagtatgctgaatcatccactgccccgcgatgcccagaacctgtgaatatgttaccttacatggtaaaagggacttgtagatgcccttaaatcaaggatcttgagaaggggagaatatcctggattacctagatgggcccaaggtaatcacaaaagtttacatgagggaggtaagaaggtgaaagttaagagatgtgaccatggaaggagagggtcagagacagagtgagccttgaagatgttacacgctggcctgcagacagatgaggggccgaaagaggaggcatgcaggcagcctggaaaagctgaaaaaggcaaggtctcttgtggcacctccagaggaagtgaggctgtgctgataccttgattttggcatgatgaaacccctttcagacttctgatctctagaatggtgagataataaatttgtgttgtttttataaagtcactaagtttgtggcaatttgttacaacaggaataggaaaccagtatcattatcatccccattttacaaatgagaaaacagaagcacagggaagttaaataacttgctccaaggtcacacagctgctaaatggcagatccaggattcaaatccaggtaaccaactccagaccctggttttggtatctgaatttttttttttttttttctgttttgattttgtgagacagggtctcactctctcaccccaggttggagtacagtggcgtgatcatggctcactgcagccttggcctcctgggctcaagcaatcctcccacctcagcctcttgagttgctgggactacaagcatgtgccactacacttgggtaatttttttatttattgtagagatgcggtctcactgttttctatgtcacgcaggctggtctcgaactcttgggctaaagcaatcctctcgcctcggcctcccaaagtgctggtattacaggtgcgagctacggcacacagcttcctcaggaaccatctgaaactattgctcaaaaaaagtaatatctgaatttcattgccaccagctacacggctatgtagaaatgcacaataagctgctgttttaactctacaaggtgacactaggctcgttttttccaggaatgctgattagttcatgctgatttattcacattagcattatgttaatgttatttatatttttatggacttagagatatcttacattagcaacttctctcaagaatgacaagagaatgaatgatttgactcttgtcagcccaagattgaaggtaagagtcatgaagctcttctccaaatgtcatatgttggcccaatcaagttccctggacatatttcaaaattataacagctaatgagtatatgctttatgtgtgtcctcacaagcaacacttcaaagccggtatttcatcttccatttacagaattaaaaactgaaactctgagaggttaaataactttgctgtggtcacacagctggaaaatggaaatggtagaatcatatatcactgagatgtatagtatgctctttctagatttcacaccaaggagtcatgttgccctttgggacgagcacggtacaaaacccagattttcctcttactttctaagttacttaatctcctgacgccttggtatgtataaaaccaggataacaatagtacctaccacctagactgcagtaaaaactaattgagttacacatgtaaagtgcttggcaaagtctctggaataaagtaagatatttattttagtacgtgtttgtaaccatttttattatagatttgacttataagttagactttcctcaatcattctgcactacctcatgttccatccagactcacatttggaaaaattttaggttctgcaaaagatcaagacaagttgtgaattgagacaagtcacttctgaggcttgcactgggtacacttaagacctgtacaccttgctactaaatcattttcatgcttagaaaatatcaagaggtcattcagttcatcctcaagttgtagcctggtcccttctgaaattcttaccttagtttgcaatacctctagagaaaaatattttatagcttcctgtggtaatcgattcgaatgtcagacttggagagatcaaaagtcatgagcacaatgccttatgtttcacttcaggttggaggtcagaaagacataaaatgctatctacgaccctcctatagagacctgggttatttacaaaggggtttcttaaatttcagctgacattcatccttctaaatcaatgcttaatattgtattcattccatccttcctgggaaccaacgaaaatctcaacttaaaaactggattttttgtttatgagaaaaaaaaatactctgcttttagaactgcacaacttagtaaggaagtgatttagtgatttactacagagtgatccctggtaatgcagtaagttgggaggaggggtactaagctggttatagtgaggtgttgaagaaaatatccaaattataaatatggagaaacagattctacatcatgcttctttattttctgtttctctggccttaggcaaatctttaaaaatggaaaactaacaactaacccgctaattggacaggcatattatgacaatcaagtgatatcctggtaagtaaagtgcatcagtgactgtaaaatactctctaacaggtggttcccagtggaagatctttgatgctatcaaagttaaagtctctgacccatgatcctagcaacatgaacacagacacctaaactttctgagttcttttcagcccctgcagcatggagtttgtgttgagatgtgttcctcctggtggctctttggcttacagagactcagtgatggaacctaccaacttagggcagaatctaatcctagaattaccaatttcatgaagccagtttctcctgtaaacctggagcccatctctgcaggatgcagccacctccctgctgctgccacaagacatggtgttaaggaaggtgtttgattcagtcttgagtggtgcaaaggttgtctagtttacaggggcccccggctacggttctaaagtagggtgtgtactctacagtggcccttctggaatatccagcttccaccactctctttattctggcataagcatgaggttgaatttgcttttcttcagaagcattcccatatttttagccactcttccctgggctccaaatgagaaagtccccaccattccccagcatacagatccaggtctcctcacattactcaggcattctgctccatttctcttatttagccctgggctgaagaaaccaatggctactcatggggtctgcctttctccaggggaaatgtgactctcttctgtgccactggatccaagtatctaccacttcctctcttcttctcccctcagcatcctgagttcactcataaccttcagacttgtaccccttccccacccaacactggacccttatcaccaacttcaaactgaattattttgattgttgtcatcattaatattggaatttaaaaatcagcatgaatttgggtactgtgtgtagccaagtaaaacaagtcacaacattatttatctatctcttacattaaaaaagaaagtgtaagaattgaaagtagagggaaaagccttaatagataagacaaaatatatcaaaggcttacaaatgtgctagctattaaaaaaaaatttaaaaggattatgttggccaggcactgtggctcacgcctgtaatcccagcactttggaaggccaaggcggatggcttacttgaggtcaggagtttgagaccaggctgaccaaccatgaaaccatgaaaccccgtctctactaaaaatacagaaaaattacctgggcaaggtggtgtgtgcctgtaatcccagctactccggagtctgaggaaggagaatcgtttgaacatgggagatggaagttgcagtgagcccagatcgtgccactgcactccagcctgtgcaacacagcgagacttcatctcaaaaaaaaaaaaaaaaaaaaaggtggggggattatgtcatttgatcctcatacagactaatgagttaggtattataacaagtgattacactgaggctttgagacattaccttcccacgtgttacacagttactgagtggcaaaaccaggactcaaacctttatattgtactgcgtctgtgacaaaatcaagcaatcaagcaatggtctttcactcctcgctgatagcttagtatgtgcatgagaaaacagtgactcaattaatacagatacaagataaagcactgtaaaggcttaaaaactctaggggaaaatgaaattaagggtcgcccttaggatcaaagaaaatccaagttttacttaaatagttaattaatcaatagtacagttaaaagccaatatgttatcattttcgtatgtatttccattgcatctgcttcaaacgtactttaaagtgcctgaggtttgccaatgacttacataattgtagaagaggcatgcaattggctggagtgtatggataattaaaaacagcccttttatggtgatttttttggatacaataccaaaggcatgatccataaaagaaagaattgcctatagtccataaaagaaagaattgcctatagaattgccttgggaggctgaggcaggaggattgcttgagctcaggagttcaaggctatacgagctatgctcacacaactacactccagcctgggtgacacagcatgacaagactcgtctctttaaaaaaaaaaggggggggggcaggagtaggggaggaaagaattgataagctacactttattaaaattaaaaatttctgttctgagaaaggcactgagaagagaatgaaaggacaagccacagactgggaaaaatatttgcaaaagacatatctaataaaggattgttatctaaaacatataaagaatttttaaaactcaagcagaaaacgaacaaccaaccaaccaaataaacaaacaaacaaaacaacagatacttcaacaataaagatacagagcaacaggaactgtccattcattgctgatgagaatgcaatatagtatagccattctggaagaagtctggatatttcttacaaaactaaacatactcttaccatttgacatagcaatcccagtcattagtatgaaaaaaagttgaaaacttatgttcacataaaaacctgcacatggatgtttatatcattgccaaatgtttatatcattgccaattgccagaacttggaatgtttatatcattgtttatatcaatgaaatgtttatatcattgccaattgccaaaacttggaggcaaccaagatgcccctcagaaggtgacgggataaataaactgtcatacatccagatactagaatactatttagcaccaacaagaaatgaagtattaagccatggaaaaccatggagggaacttaaatgcatattactaagtgaaaaaagccaatcccaaaaggctgcataccatatgattcaaactgcatgacacttggagaaagcaaaactaaggacagtaaaaagaacagtgattgttgggtgttggggaatggacaggtggagcacaggggacctttaaggcagtgaaatcattttgcgtgataccccattggtgcatacatgtcatcatacatttacccaaacctacagaatggacaacaccaagggtgaaccatgatgtcaactatcaatttaggttcatcagttgtaacaaatgtgccactctggtgggaaatgtttataatgggggaggctgtgtgtgtatagggggagggaacatataaaaactctctctataccttccacttaattttactatgaacctaaaactggtctaaaaataaactctatttttaaaataatagctcttttatgtcattctacgattactgttggtaaggacgtaaggctctaataaagtagcaaatatgacatgattgttttaccctcctgctgtgtttcaggatctatgatataatcatagacaaaacccacctatgatataataagtaagccttccttatggacaatgttgctcaaaactcagcatctctaaatgcttggagaagagttcaagcccaggaacctcacaacctcatctccctcaagaagatgcctgcttcccccaggccttaactggctcccatacttcccgggcctttatccacagcccttttatataagccagctacttagttcatgggagctttcaagcaatgacatagtggcaatttacattagcatgctcttctatacatcttttaaaataggccatagctcttggagtagaaaggtcactaaaagaattcccccaaccaccctcccttaaattgatttcactaaatttagagagaaaatacacaagtgtgatacattttttctgcctgtgactctctaggcttacacatatcttttaacttgtacacaataaaataatgagaataccttcactagaaggatgaaagactggtattgatataaaaaatgcttccattaataacatggattaatggccagcagcagtacttggtgtcctccttctctagtgttcacatttatgaacttgaaatgagtactatcattaataggcctcatttacaggctggcagcaggttgccccaccaaaagcagaagtgatgattagttcatttgaagaggaggatgtttagagctcacagaaagctggactatcaaagaagcacacctctctttcaaagaaaggaaaggtacattcatgttgttgtttttttccctcttcaaagcttgtctttcaactggaggttggagagaagggaatgcaggcttttaatccaaatgataattgctgtcaaacaacctagtctgaaatcattttcattatgcactgagtcatcaggatctgtcatttctatttttcccctaaacttactgctcatggcttttctctttctaagaaaaagttagaagtctttatttctcattcaagttaatttaactcacctttactgagtacccactatgagccataacaggcctgcgggatgcaaacataaataagacactgttctaatctttgatgccctcacattagagtaaaggagagagagatttagagaagagttgcattaacaaaagtatctaaaacctacagagacagaacaatgaagcaactgattgactctatttgggtgagtcaagaagacttcagaggggagaaggtgtctcaggaaaccattgatgtgcactcggtatgctttcagaaaaggagggcatttctccagacacagcaacatgcaccaatgcccacaggcctactgtaattagctcagtgtggtatgtgtgcagcaaaagtgaaatgaggctggggaagttggcaagggaaaaataatgaaaaggcatattaaggaatttatattttaccttgcaagcaatgaaaggccattgaaaagtttctaaaagaaaaataagacaaatctatatgacttttaggaaaattactctgttggtggtatagagaataggctgaagaaagtctgtagggaggtagttagaagcctatcgcaatggtccaggcatagttgaatgaggatgcgagcaaacactgtagtggaagggtaaaggagaaaggtcaaatgtttaagtcttagtaacagaataaagaggaaggtgtcagggatgagtctctagattttacttgggctatttcagaatggtggttaaaaaatccagcaggaggctgggcgcggtggcccacacctgtaatcccagcactttgggaggccaaggtgggcggatcacctgaggtcaggagttcgcgaccagtgtggccaacatggtgaaaccctgtgcctactaaaaattagctgggtgtggtggtgcatgcctgtaatcccagctactccagaggctgaggcaggagaatcgcttgaacccggaaggcagggttgcagtgagccgagatcaggccactgcactccagcctgggcaggtgacagagaaagactccacctaaaaaaaaaaaaaaaatcgagcaggagaaccaattttggggtaaaggcaatgagtttattctttccagaatggcagtgggtgagttatattctccattactctatcattgggtaccatttgtttctatgatttttagagtaccaattctaataactttaaaaatatttcaagtgtttcaaagtgaaaaagctcagcaggtgattggtaaaatagttaccaaataccaagatgaggttggaacatcaagattacactaataagacaggagtctcttgcctagagtaaacacaggagacgcaaaactctgatcagacaagaatcttgccagcagcagaggcacaacacgctcattcacgcatgtgaacaaatcaacttagacataataaagccaaagaatctgatgaggaatgtttgggatcagtgactgggttaaaataatagtagagaaaaagtacaaggacagagcatcacccgataagggggcacaatgtactttgatttggactgataaaaataggtgagttgattcaggtaattctttttggtttggtagcagtggtgactgggcaagagagaaaatggaagaggttaaaaacaagaaaagcccaccaagtaagaaaggatgacagaataggcacaaggatcacagaattgtcagagtgaaatattggggtcggagataaaggcagacttctatgtagccaattttaaacttagcgctgaaaaagacattttaaagggcaagtcagagtaggggcagaaacaatgagctgccttgatcacaaatactacaagatctctaccacagacttgaatgttttatagcaaacagcaatgaaatcaagacactaagggcttgtcactgcaatactgagcattatcatagcgactatagctatgaaaaaaattagactaatttgaatttaattcccaacagattcatatttcaaataaaaacacaaaaggaaacagagaaaaaatgaaaaaaccctgcatttattgaacagaaaaacatcctaccatttggtgtcagtaaaaaaatggacatttgaaataatttagcaagcaaaattgcccaatcagtgattctggagtccctaatgaacctattagggaccattatgggaaaatgagtatacagatgcagatgactcctatgtcacctacttatgaggtcaaactgtaatagacataattctatgagaattatgagaattttcaaaatgatttaattctgcaagttaattgcatgcagtattcatctgtgagtttattttataatttgcatacacacactaatgcctcagtctatgcacatgctaatatatatgatatgaagactcacaatagtattaagaaacacctgaaaaattccactcagtcaactgagtttcggcagctgtgtagcatgaaaaacaatgaagaaagatatccccaaagggataagcttgggcttcaaaggccaaaaaagaaaataggaattgatagcacagtggattccagaaaagcatattaatagtctgctaagtgacatcttatttatgagaacaggtatcctacctggtcagtctgggagggtggacaaagagttcagctcaacaagtattaatggcacttactctgtgcaaggcactctgctaagcgcttcagattaacagagagccagatggattaccattcattgcccctctgtaccaatctctcttatctccgtattgtcaccatttatatttgataagtgtgtttaatagatactataggtagccattataatcaataaggttgcaaattcaataatttaatccttgacccaaatgggaaattattttaacttggatatttgtattcccaggctttggtcctgcactgctgtttcatggtttaggcttataaattcaagccccattcaagcccataagtgcctcaagctgcagctacagctacctcaagcacacaagataaaatgtcccatcaacatgtaattaaaggaaaatctctactacttggggatttaaaataataataataataggcttctgatattgattgccaactgaagcaaacttgaggctttccatctccaaagttattatttcaagtataaagcagtggaggttattcttattaaggaacaataatgagctatcagtttggggtggtggcttttaatcactaatacaattgtgaaaacccaacatttttctaatgttaatctgctggggaatgactacaaaacaacgtaagaggcaacttttaaaaaagaaatatttgtcctagacaagagcagggaaggaacaagatcattagacaacgacagtaagggctgcactgttaatgaggcatatgtaaaaattctcctagctgattggttgacatttttcttgccagtgatgttattattcaccttataaagtgaattcattttacatcagggcataatattaactctgaaatacctaagattttcacactactgagcaatctatttagactgaaacctactgaactcctactgtgtgccaagcttgatagaacaagagtccccaaactctctaactggtcatttgggctgcctgagaggcagaagagagtaggagttatgtcagcctctggccctctattgcctgactgacaaggtcaaacatgcacagacagcccagtgagcctctttttgtttttaaagggcaggtcactcagctactattttctaactggctaacatatttttaaaatccttttgaaattgaaagagtttccaagtaaaataaaagacactcatttaaatgtgaatttcaggtaacgaggaataattttttagtataaggttatttcaaatactaaatgggatatacttccattaaaaaattatttgttttttctgaaattcaaatttaactaaacatcccatatttttatctgcaaaatctggtacagctgaggtcacaaagatataaggaaaatcctcagggtggaagtgggaagcaaaaatgaacgaaaatctgaaaatctgagtgactggcataatgtagacccttcccatgtgtttgtttcctcttccctttctccttctctcttttcttgtgcctctgttagtccttcaagggataccaagaagtgtatgtccttgtcctcagagagcataccattaataaaacaaatacagtcatgtaataaaagatgatatgtgctagtattgaggaataggctagaagcaactttctataaaaagagagagagagattaagtataattaaacatatatcaccatctaataagcaaacattgtttaaagtaattctaaaacacaaagatgtgagatgaagcagggcactgcacagcattttttgattattcaaggcattcttcaatacatatttttgaggcatgctcttcaattccctacgttattttctataggtatgagctcagtctcctgcctttgtaagctgggctcaaatctcaagtctcaagtggggtttcatgaaatataaaggtgtggccataaaggtggccacagttagctgacaaaacaaagcaacaccaccagaaattgaggagccatacctagaacctaaagaagcctttatcgcttcacgggggcatcttggggtaaacatcctcctttcacaaatgcctagcacaaggcttatatttgcctattctgtaaatcacatttacaaaggcaaagtaggcaaaatacttaaagacacacataataaaaatacagattttaaaaataaaacataggaccaaagttttctataagcttcataaccctggctattttcacttgccaaagtaagatcagcaatgatttatctacccttgcccctatgccctcccattatggagattaatttcaagtactttgatgtcagtccccttattgaggacatatatattgtataaattctttttctaaaaactaaaagtatatgcccatgatagaaaaacattttaaatgaataaaattacccagaaaaaaacaaacatctataatacctgctgataacatttttgtatttcctattagttctcttctatacgtaactcatataatcaagatcttattgttatgtataattttatatcctatataaaattttatatatacaatatagaataaatgttaccaatacaattgtatattggaaggatatatcatgatttggttaatcaaacttgttcattttagtaagatctgtttctggagcagactgtctgctggatcccagcatctccactcactgttgtgtggcctttagcactccctgcctcagtttcctttgggtgttgttatgagtcttcaatgagttaacagtaagtattaacacttacatagtgcctgacacactatgaatgctcaatatttgctattagtatttttgctattatgaaaacattattttgtatatcttttggggataagaaactagaaaagtcataacaaaagtatagataaaacaaaaatgcccaatgggactgatagggatgtctctgatactgtaagaaataacattttgcatcagtttccagtgttgagcatataatggatactcaattgatgctgaatgaattaattaatgaatcaataaaccaatgtttttgagtttagggtcaaagatgcatttttatttatttccatgtgtaaggtgtgtctctggaaactgaaacaataaagtacaggaagccatcagctgcttacgtttttaggatcaaagaaaaggtatagtctgtaggaccccttgatataatagaatgaaggttgttaaagttgtcaaaatatcatatacatctgtatttgaaaagagattaattcatctgtttaaaagagctttaaactaaaattgtcaagaaaacaccttaaaagaacctgagaaaatatctagtaatagtgtagagaaaacaatagcaaaaagactgaagatcaaacctcctaagccagttcctgaagagtatactaccatttctcaattaataaaaaatgcttaaggataaagaaaacaattctacttataataacatcaagaagaataaaatgtttagaaataaatgtaaccacttgtacactgaaaactaaaaaacattgccagaagaaattaaagaagacacaaataaatgacaaggtatctcatattcatgaattgaatatgagaatgaaattgaatgtgagggtttatttaggagctccttattcatgattgttttgtctattttgggttctttgatattccatatgaattttagcatggattttttggtcaaattctgcagaaagcactgttgatattttaatagggattgcattaaatacaaacaatcatgaaaagactaacaaatctgaagatctcacactttccagtttcaaaacttattacaaagctacagtaatcaaaacagtgctagcataaagaaagacacagaggccaataaaacagaataaggaatgcccaaataaaccctcatatatatgaccaaatgatttcaacaagggtgtcaaaaccatttcatggggaaaggaaaaactttttaacaaataacattgggaaaacaatatccacatgtaaaggaatgaagctggactcttaccttacaccatatataaaaattaacttgaaatggatataatatttaaacataacagcaaaaactataaaactcttacaagaaaactcagagaaaaagttttatgacattaaatttgaaaatgacttcttggatatgccaccaaaaacataagcaataaaagtaaaaatagataaaattgactacatcttaattaaaagcttccatgcatgaaataacacaatcaacatattgaaaagtcagcctttggaatgggagaaaatatttgtaaatcatgtatctaataaggggttaatacccagaatatataaagaatcctacaactcaacaacaaaaatcaacctgattttaaatgggtgaaagacttgaatagacattcttccaaagatatacaaatggccaattagcacacaaaaatatgctcaacatcactacttattacccagaatatataaagaatcctacaactcaacaacaaaaatcaaacaacctgattttaaatgggcaaaagacttgaatagacattcctccaaggatatacaaatagccaattagcacacgaaaatatgctcaacatcactacttattaggaatacgcaaatcaaaaccatgagataccaccttggacccattaggatggctactatcaacaagaacaacaacaacaacaaagaaacagaaaataacaagtgttgctgacgatgtggagaaattggaacctttatggattgctggtgggaatgtaaaatggtacagccactatggaaaacaatatgacttctcctcaaaaacttaaaagttattatgtgcttcacaattccacttctgggtatatgctgaaaacaattgattgcagggtcttaaagagatatttgttcccatgttcacagtagcattattcacaatggccaaaagatggaagcaacccaaatgtccatcaatggatgaactgccaaataatatgtgtacatagatacttagatatgatgaaatattattcagccttaagaaggaagaaaactctgacagatgctgtaacatgggtgaaccctgagaacattatgctaagtgaaataaaccagtcacaaaaaaagaaatatcacatgattccatttatatgaggtttctagaatagtcaaattcatagagacagaaaatagaatggtggttgccaggggctgagaagtgatgggaatgatgagttagcgcttaatggacatcgactttcagttttgaaaggtgaagtgttctagagattggttgtacaacaatgtgaatatacttaacactattgaactgtacacttaaaatggttaagatagcaaatttcatgttatgtattttacaattaaaaataaagaaagaaatgcacaataaaaatgtttaaagatcaatatagggtctgggcatggtgactcacaaatataatcccagcactttgagaggtcaaggcgggtggaccacttgaggtcaggagttcaagaccagcctggccaacatggtaaaaccccaactctactaaaaatacaaaaattagccaggcgtggtggcacatgcctgtagtcccaactactcgggaggctaaggcaggagaatcacttgaaccttggaggcagaggttgcagtgagccgagatcaggccactgcactacagcctgggtgacagagtgagactcctctgtctcaaacaaaacaaaacaaaagataaatataggaacatttgataatacatgctttctggtattaatttttgcattccacttctatttaaatcattttaaagttctgtcttcccaagaaaactgtaatttttgtgggctcagggactgagttctatgatctgggtacactgcagacttacaacgtatctttgatagctaactgaaataaaattaacataataatgttggactaatcttttgagcctcaaacattaatactctttatactagctgagtataatcagtaggtcaaggagaatctctatcttgcaggaacatctattctgaaagacagaaaagcctgaacaagaggactctatataattctcttaatgaagtgcacaaaggactactggcatgtaataaactccttacctaccagtccttcgagggtggaataatttggtgtctaggtagtctaaacctctactcctactcctctcccagaaaaactgtctgtttccattaaactggaatattcatcattgtccaaatttgcatcacacattgtgcttctgaatcttgattcacactatttctcatgcccgctattctcttgcttcaatccaacaatgctcacatctccctccctgcaagaagtattcctcatcaagaggctttgaagactgccatctttggtgattactatcatttataattttcacttgctaagatttttaaaagtctactctataccctccttcttcaatgagatctagtcaccagttctaaactgtacatttgattgtctccttgacattttcccttgaacatctcaaagtcaccctaatgtcaacatgctccgaattgaaattatcccacaatccagggcctcttccagttttgtcttagtgaatggacccttttagacaagctagaaatatgagtcatcttcatccccacatttctcttatccccagtatctgtcatggaattctgttgattttatctcctaaatatttctgcatccaccagtttcttgctgtctcatcactaacctggtccagcattgttttaataggctttacgattatttaggtatggcaaagccaaaagatcaggagatgactaacaccgaaaaaatagttcattttggaggctatgaatatgtttcttaccttgattgtagtgatagtatcacaggtgtgtgcacatggccaaaatcatccaatagtatacattaaacaggtgcagactttgtgtatcaattctacctcaataacattgtagtttttaaaagacaatttattctacttataattcccaagaaaggagtacatgtcacaccacagggggccatgtggggaaacacctgggtcagccacggggcagaggaagaggggggacctgtaggcaggagcctttactgtggtttccataggaaaggatgagggaggcaggctaaagaggcttaggactggctagtttgaatgacatcagtggactctggagcatagtggcttccctggttgtctggcatctggccctggcataagtagggtaggtggatagtagtccagagtaggaaagtccaataagggagaaggatggaggcgtggaattaatcagctgctccataaggggaaaccactgacctctagccactgcctcaaaaccaaggcaaaacagcattttaaaaactgtattacaagccatctgaacctgcactgttgacttcaatagcctcctaaaagtgtcccagctgtcattctcttccactgtcaactccttcacccctgcttcaaatcctttaggggtttcctgttttcttaaatacaacattttttaacagggctacaaacccctgaatgatctggtcccttcctactttcccaggcacagctgcaccttgcttcctctagccacagaccttaggtcttgtctatatatgtatataatttgttatttacttcacaaaaaggtacttcctgctgagaagatattagttgtaaggggcttgatgaacatctttaatcaattccagctatatgctttaattttatttggcaaattgaataatgttatttaacttgtattaatcagatgttgctatccattacacatatagtacttatgtatgtcattaatgtgaactttgaaggtaaaatggccgatttcatatgaagagtaggtttcaggtagacatgttaaaatttgattgagtcttataataaaaattttctgttcaaaaaaatccctgttcctaggaactttatgagtgaatatagccacaaattctgctttagaatgtgtctgacacacacattagattcataaacaccctcaagacccaatggtggctgggtaaatggtaaaatggtagttaaaaactcatttcaagatgaaattcttcctacagcatttaaactgcagatactggatatgagtatgtgttttaatttcctttttgttggcacattatcattgttttagataaaacatttatttaaaaggcagcaagtgattttgattcttgcattggtcataatttctctcattaacttgaacattttgatttatgttactaggggataggaccagtcataagcattatgctttatatcatatccgactttcaaataccgtaatgctaacatcatattaaatcaatagtgggctttgtagaacaacacaaagccaagttgaaatttgtaataatcttcagttctttcatttctaaatctttaatcatttttcctcattcttcttccctccttccctttcttttctctctctctccctggctctttccctgtctccctctctctttccactcctcttctctctcttctttctcctaacattaatgcattaaagtgagtcagtcattcagtacttcaacaagaagttactgcacatttcctctatgatgaacactatacagggccctaggaataaaacagtgaataagacagaaaatagtcctatctgtggggagctgacaatccaaaggagtggctgaccatccaacaattacaacccagcatggaaaatctatggtaggtaaattctggggtactctgaaaatacataggagggtaaaataacctgaattcatgggtcacagaaggtttcctgggagaaataatatctaaactatggcataaaacaatgagctatatagacatttctattcatttagtcaaaactttaaataaacagtaaaacctaattcactgcattctcaaattacaactccctactcaacttttaaaattcatttcaaaggcacttttttccctaggttcaaaattttgtatttctttaaatgaaaaaataagaaaactgattgagagtcaaattatgggtattctgactctacccagttccttcaccaacctctgtgtcatactgaggaattcacatcaactttcttggtcacagtcccaaatttataaatgagaggatggcaattgatgggctgctttccgggatgggattctgattgcaagtctctgaaactttctaggcccagtcttcactatttcttgcattttatccacctaggttctcccaactgtactccatcctgcatattgctgccaggttcatcctcctaaagcacagttctgtcacttttctgcatccagcatattaacagcccgcaagacaaaaatctgaactctttctgcagcacctcttctccctggcatgagctttctaccttggacagctacaattcatacctcagtgctggactcactcacacttgctccttcctgctaaggagaccttgtcctcttctatctggccataaccatttcttccatctcctacaaggctcatctcacatccaaacctcctccgtgaagcctgcacaggtcactccagccagcatcaattcctttctctctaaacatctacttcatcacttattttgaaacatcctttttattatctaacactgcaatccatgttatttttcactacctaatgatactgcaaattctgttagatcttaaaaatccttttggctgggtacagtggctcattcctgtaatccaacctactcgagaaactgaggcagaagcattacctgaatccaggaggtcaagacttgcagtgagctgtgtttgtgccactacactgcagcctaggtgacagagcatgaccctgtctcaaaaaacaaaaatgaaaaaatccttttatttaccttccttcctcacccccacctcaatagcaatgtgaagcccatactatttgctgaatcaaatgaaataaatacataaatgtttacctggtttctaaaaggcatgtgggctagcccaagagtaaagagacctgacctgaaagaaacaaaatatttcctacatcttcaatctgtcccccttcttcactttcaaggaccagctaccttttggctggtaaacatattctagtggagaaagcacatgaataggagcccagttcaatttctggctctgtcggtctgcagctggagagctccaacccagtttctcagtctttctgtgccacagtttcctctttcctcatctacaaaatgaaggatatcggtccagaaaatattcttaagtcccttttccatgtttgacttatggagatacttacactttataacccagagcacatatagctaaacagaacggtaatcggttaaagagaaaggcaaagtgagacaaaaggggagatgagttatattacaaatctaagagtcaaaaaagaatttagaaaacgattttaagggtaaggtaacagcttatccattgaatacattattcctctaggaagctacctacacccctgggcaatcatgaagcaatttaaactttagttcttttatacagtgcttcttatgaatccagatgtgggttcctgaggtgggtacatcattttcaagatgttggaatacttctggattagaatgttcctctgttgaataatgaaactgtattgtaagacttagtaaaccatcaacttactgtattttcaggttgcaaagtttttatgttgtttggttttaacactttataagaatggacctcacattttctatcttgaagtcacatatcttgatgcaatattggccttaaatgggaaagccatgtaatagaaactaattgaacattttcactgaaactagaggatgttcttaggaacaccaagaggtacctcttagatgtgtaggacatcagatacactcctacaaggggcactacagttgaccaacaaagaaattcagagcacattttctcaaaagtacatctttctgataaaaaagtaaatatatttatttactattttcagataggtatcagccagcatgtaaccacatacacacacggctaatatatctatcaactgatagattagtttgttctcattaatatgaatgtgacctctctcctggtaatgtctcctcttttgggcttcttggcttttaaatttcactccctcgtttaacatctctgagcctggactttcttatcccaataactaataatgcagctaaggtatctagtatgatatctgggatcttttattgattgaatgatttatactgacttcattccaaaagtgatttgaggtaaatactcagcaaatagtaggcgctgaataaatgtcagttttcttcccctttttcctttgcttaaatcacccctaattttcttgagaacaaaggataagctgaaaggcaagagaaatttgggaatagaggccatagaggtaatatgttagtaagcattagctgttccttttcaaaagcttcatcatctgaaagacggcatcctttacaacaccattacctcctacacaggacatctggaaagtggagacggggctgcacagtaaaagcacgaacattggtaagtacgttgctctactataaaagaggaagttagaggcaggaaaatgctatcatggctagaacagctgtctatccaagagctcagcagcccaaagccaaaatatagagttttattacaattacatttgaaatttatatagcctttttatactgcaaacagctaaccaaatcttcatcgtgcaggtttcagtgctaatttgtaagattttaccagctggacctttctagaagtaaacatgatgccatggaaatcagaaggcacagtcactaatcagttcagtgacctgggcatgccaactttacctctctgaactcagtttctccattttacaaattggctcatttaagtgtcctgtcagctctaaaatcccacaattccatcttcttagctgtggaaactgggtaacttaaccaagcctctgatagtgtatggctaagcaggatcttggatcctcatttcttcattctctgaattttaaaggtgtttcttctttgtagtaaataagcaaagtgttaaaaaggctgagcaccttttcttttatcccaaatcacttgtaatttttaagttctgtcatttttacagatcataaaactttatcaaaagccaacctgtcatgatagttcacaatatttacaattcagattttggcacaattaatattccttttcctcatcacatcatcatccattatagttgtaatctataaattgatgggataaaatttcaattaaaaaatccaattgaactttaggggtttacagtcttctataaatagagcttttgaaggggactgagttaaggctgtaaagaaagatgtctataaaaatacaaattcattcttccatttctggaaatctttttgtacctactttagtcataaaaattatattttacattaactgtgccaggaaattttttttcacatacaaatttgatatctttccaaaattgcatgatttgctttaaagcaggaaagaggccaagatttactcggtgtgctcagttagcagccctcccaagaagttcaaactgaggtcaaactttttaaaaatgtcatttagaatgagattcgagtagagtataatctcttagtaccacctgagtttagttaggaaagatttttaaacaccccaaaaaataaaaaaatgattagacacactaacaaagtgtgtatatatacacacatatatatgtgtatatatgtatatgtatatatgtatatatgtatatgtatatatgtatatgcatacaggtatatgtatatatgtatatatgtacatatataacattccatcaattaaaataaatctggatttcttcaaatcagtataaatttacatatattttataaatatatattttgataaaatgtattttccaaatgccaattaaatagagatgtcaactctaatgattttgaaacatttacttgttacattattaatgggaaatctgggccaattcccatgtatttctcctaatgccaaaagatataaaatgattccatttataattcagagcctggagtcactgcaagtaaaacagttttactgttaaatattgcaaatcattagtgctatcagcatatatgcctttggagaatagactcacattctaacacagaccagcttccatttattgcaagcataagagtaagtaaaacatgccaagctagcagaacacatcttaaccctctcaggcaattattctccttgtttaagtttccctcaataagcatgaaaagtaacagacaaccaagatgttatgagcttggagtgcatgtctcataaaccaaacgtgaggagctttttcttccgactgtaattctcaagcagaagaggtttctttatatgaacaccaggaaacggagattttaaatccctaagttgcatggagcttgtgaactttcaggatgctccaatagttccttaaatactcccaaatctttctcatgtggggcaagctttttttttcctaagcctttatcatctgtcagcagccagtgatgcattagatatacggcttcatttctataacaaatgtaaaagacatacccaaaatgaattatagagaaactagcagggcaaactgtttgactgaacttcatttttgaaaatttatctttttttctccttacataatcaaaagctcaagtatctgagggagccattttaacaactctgctcttaagtaataattaaatctgctgccgcacaggagttctgcatctttataaatgtcaaccccattctgaagaatccaagctgctccccagcagtttgaacaccacgtttataaagatataagattttgaaatgtctttttctcacttatacatttataaatcatgagccaaagttaaatcccaaatcaagtgtgtaccaacaattactggcatgtattctaataagagaacccttagcaaattaatacgagtaaacactatattgaggctgcagaaagatataaatatctgaagttcagttacacttaattttataaggatataatttgacaattcttgaatatgattggttcctatcaatgaatttttcaaacctatacacaattatctttttaaagaatagatactaaaaataggttatttttctgattcacaagctcactgaaatatgtctgactctattaaggttaataaataatgaatcttttcactctctttgggttgatgggcataagaaaaaaataaggtaagggagaatttatgagcaggagatttattgagcactttctagatgccaattgttaaacactaggaatataaataaggtacagtttgcacctttaatgtgcaatcttgggaggggacagacagataaacagactgtatcaaaatgaaaacgtgcgacaagacagaggacacacaggcgagggtgaggaggagacagggaaggcctcccagagaggaaaggagttgcaggatggagcaagcaagggcataaaggtcaaaggagaggtaagtttagggtgactgattacaaagatgagaatggtggtgagggactaaattaagccagctcacagacagccttgtacgcctcaataaggagttttggattgaggaaaatgagagcttctgaaggattttcagtgtaatttagataaatattttatgttagttactctaggaatggtgtggaggggggctttgctggaactagaatttaataagcagctattatatgccaggttcttataatctcattgaatcctcacaataatcttagacttcattatctccaatacatggctgaggaatagagacttagagaaattaagtgattcagcaagattacacagttggtaagtataatagtaagacaggaattaaaatgctgcctggtatgcaaaccccaatttttccaactatatcaccatgttgcacaaaatccaaaatgaaacgtaaacaacccatgcttcatgactaatacatggatgctcttataaattaagatagaagtcagtgttgatataagaggaatatgtaaaatggggccaacattactatacacactaccctatacagcaaataacatagagaaaccccaaatactttcactattgagttcatatcccatggctctttgtaaagagaaactacttactcttaaattacagtgtccatctttgtcaacatcattactacttgaagtgatgttttcatgctattcttccttttctatctgcttattatttatttatttatttatttattggcgtgtgtgaggagtggggagctgtctagcggagaaaccaaactagtaatcaaatgtctcaaactacattaccaggtcattaagcctaagttggaagtattaggctttatcagctgctattgtacacatgaggcacattatataaccaatcaaatgctattaagtcactttgaaggacatcactattttctcaaaatcaaactaccctctaagcaagttggttagaaaaaaaatagtcttcagagtgttatagctggaactatgtagagcaagaatacatctttgcattgtttgttttgtgtctgtatgcccacttcagggattcaatattcccactttatagatgagaaaacttagggtcatgaaaaggaacgacaagtacactttcacggagtgtgtgaatctcagacttggggcccttgcatccaaatctgttgattcatatcacttaatcctttctctttatgctttagaaagataaaaacaataatttagagtgtattttcaaagatcaaagcatttataaatcaacaaggcaatagaggaagccattttttccatgtttttacaaggatattgtagatcttttaactttctaagatagcaaaaaataaaagcctgtggttctcattatccccaatgctaataactaaatataaacatattaataacacagtgtgctggagacatgaacagaactacctagattctgccacaacagtgttctccaaagtgggttctggggaacactaatcccataagatattcttttattgttcctataagtttgtgaaacactgaatattttattctcttcatgcagacttctaacctctctgacatataaaagttttgatacatcttgcaatgcaaaagacctgtttaaccttatttaaatcagagtttttctaaataataaaaattaaaaaaaagggatagttgaatctcagtgattgtgagcccagaaaattttatagcatttctagattcaactccaacagaatacttaaatcaaaagtgaaaccatctttgacaaacctgacaaaaacaagaaatggggaaaggattccctatttaataaatggtgctgggaaaactggctagccatatgtagaaagctgaaactggatcccttccttacaccttatacaaaaattaagtcaagatggattaaagacttacatgttagaactaaaaccataaaaaccctaaaagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtcaacagccaacctacagaatgggagaaaatttttgcaatctactcatctgacaaagggctaatatccagaatctacaatgaactcaaacaaatttacaagaaaaaaacaaacaaccccatcaaaaagtgggcgaagaatatgaacagacacttctcaaaagaagacatttatgcagccaacagacccatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggattataaaacatgctgccatagagactcatgcacacatatgtttattgcggcactattcacaatagcaaagacttggaaccaacccaaatgtccaacaatgatagactggattaagaaaatgtgacacatatacaccatggaatactatgcagccataaaaaatgatgagttcgtgtcctttgtagggacatggatgaagctggaaaccatcattctcagcaaactgttgcaaggacaaaaaaccaaacaccgcatgttctcactcataggtgggaactgaacaatgagaacacatggacacaggaagaggaacatcacacaccggggcctgttgtggggtggggggaagggggagggatagcattaggagatatacctaatgttaaatgacgactatggtatacatatgtaacaaacctgcacgttgtgcacatgtaccctaaaagtataataataataaaaaagtgaaaccaaagcttggattttattattttaatataattttcacattaaaaatagtaatgattaactactgtgagccaggtgttttgttaggccagtggtagcaaggaagttgaaactaatgtgtcactcacagtgaatctgtagtaagcagctatctctagggtggagttcagaaatactatggggctctggctagtctcaggaaaaaaaaaaaaaaaagaacaatttgcaatgttttcctcaagcacagaattgaagagtggaggcataagttaagtgctgggtattttccatctatgctctaggcactgaggatatataaatgaataaaatgtggttcctgacttcaaggagctcattttgaggtgcagggaggtaaggcatatcatcatataaattcaaaatagggagacaagaataagagtagtaagctatcatagaaagaggaaaagagatgtgatcagtgagcttcaaagactggaggacacttgagctgagtcttgaaggataagtacaagcttatcaagtgtgcagagatgatggagtgtctgaaactacaggtaaagccatattaatgtcgagcacagaagtgtgaactggtgcagcaccttggaggcttttggtagctcagtatctcaggagtgtgaggtttatagaggaaacactgcctacctttcctttgatcatgctttccagggcaagtctctcaacaatattcaccatgtttttttgttttgagggtggggtgttaatgtatgtcttcactttcagtactatgaagttattcagcatggtaaaggaatagatattctccataatttaataatatggttaggagattactgtatatataagagatcatttttctaattttccaaatggtctgtatgctctttactaaaacaacgctataaaagtatagaaaattatatatataatatatggcactcttactgcttctttgcaagaatttactttcaacaccataggtttcataactcagtttttatgcttaagaaattaagatgaaagtgaatctattgtatgatatatcctggaactactcttaaaaatataaattattcaaaatcactcaaattgacttgtgtttcttggcattttttgacttttttttgcagattctagctactaaaactctcccccagatggaatactaggtaatagtgtctactgtttctctaggaaacacttcattttcctataaagaaagataagggtaaaactttaagtggtcaagagtccacttttgaaagtgtgttgagacaataatccaacagaatttataataggcttctttcggagttgctatcacctcacctctatcctctttgcatttaaaagaaaatcctctactccaaggagacatggaagtgaagcaaaattaagaaatattaagaattaaagatgagctagtggtatggggggagagggggatatgagggaaatactaattgaagtggagaaaaatatcatcctggaaaaaagatctagtatttttagcattaatttggtgacttttttgtggttgttggttatgggaaaattttgatgtatcagagctcttccgttaaagaatgagataactttgcccatcaacaaatgatcactatacccatcatgactaggctttttggcttagttttcctattacataatccctatgaatctgtccaggtattttttcctaacaatttctaccataccctacaccacactttgcacatttgggaatatgagccatatgaaggaatgtgaattcaccattgatatcagccaaataagccagaagcaaaaccatttttgactctaaaatactaaacgcaacaaattgccaggaaatagcaaaatgaggcccaaaagactagcatattctccacattttctgaaaaaaaacaaaaaaacaaaaaaacaaaaaaacaaaaaaacaaaaaaaaaccagtattagccatcacagaaatagaagctatttagttcctttagcatttgtgtatggtccataagttcctcacaagaagcaagtttcatttttgccaactgcacatgattctgcttctaaaccattattcaaactcgaatattaatttatgctttcaggtaagtacactacataaataaataatacaagtagaaaaaaaagtgactctgaataaaataattttctcagactgagcaacaatcctcctaatctacaggaacaaaaagtagttgccatcccttatcttactgggatgtctaattccattctctatgggagactcatcaaatgaacttagacaaaacaagcagtatcatataagtgtaggtaattacaactatattaacctcagaaaatggttttgaagagatcactgtcaatctgggcaattcctaaaaatagtgctctgtgggtgctgcagggctgtgttattcaacatcctgatgaacactaactagcaggcagcaccagttgcacttgggggaaaatacttggcttcttagtcctcctcagctcagcattaatagatagtcctgtcctattactaattcttcatctgaaggtcccctatctgcagccagtttctcctttcctaagatggcagggctctgtttatatttccaggcatcctgatgtagaaactcagatgactcacatgcaagatataagtgatcatcaccttcagtcaggaagtcaccttaagtgcttaacttacaaactttccaaaatttacaatttaatataagatcctcagatccttggtccggaaatcaactctttcctttgttatctatagcaggggctataaggatagataacttatcggaaaagcctgggcttctaggaggcagcttcttgaagaagcttgggctttcgagtctgacccaactaggtggaagctttaagtcatcacgtgcttgctgtgtgaatgctttgcatagtttcctttcaggacagtggtatctatctcttagagttgttacaaagattaaatatgaacctcagcataatatgtaccaaacacgggcacttggagcattcgtctcttagcccctttttgaaagtgtgttgagacaataatccgatacaatttataataagcttctttcagagttgctatcacctcacctctatcctcttcacatttgaaaggaaatcctttttgctggattgtacttttttgctgaagtgtactttttgtaacatgctgcccattcaccgagtgtaagttccccggtggtaggtatcctgacttgaccacatctgcaacacaagcccaagtccactgcttggtgcagattaggctctcaacacctgctttacattaaagatgtggaggccttatggtcaatgcatctcaaactttaatgtgactatgaatcaccagagaatcttattaaaatgcatattgcgatacataatgtctagagtgggcctcaagatactcccttttttataagcaccagatagacccatgcttccagaaccacactttgagtgaacgacatgctagttttctttccttactttctgactgccactatattccacattgtggcaacagaaagcagtttgtggacatttcattcaaggccattacactatgctcaaccatgtcccttcctcaacacacaaaaaaggggagggctacccaggataatatcagtgtggagactatttgctgatatatctctaccttattaggacaagctattaagtgaactccaatatttatcatcagaaaaataaaaaggtccttaaggaaacattaacagttttactatacctcttctagagggtaatgatacataataatattctggcatatgatacacatttataaatcattggcatttaataccttgtatttcaaaaaagtgtcataccctacgctgtaatgttaacagaatgagtatttataaatatacatgccagaaatgcaaacagccacatttgcaaaggcaactgtcatctggttaccacacagtgccatctgctggacagctgctgatgtgcagcagaaaaaaatgcaagatgctctccaggaataataaaacatttcctgcagcttttcaatgagatttacacaaacgaaggcaacttacacagttctgcactggcttgttcagaaagaagattttatagcccctatgctcttttgcttagaaaagtagaacaattttatagagatacgcatattgctgtggggctaaaggctgaatacagaaatcccacatggccatggagaacaaagaactgtttctttcttctgaagaaaaatctagttttcttattaccactgaagtttacatgagtattgtcttcatcaataaaataatagttcacactattttgcagcacctctcacaaacaacaaattgatattaataaaataaaaactataattttctaatctatttcacttctgaaaacaggctcctcttgaatcctaaaattggtcaaaattctttagcacaaatggtaagaaaagaataagtggaaaagacataagtcctatgtaagtccttattgatatctttcatggaaaacgcaatttgttctaccatagtaatgctgtaacttggaaatgatttaacaatttcctacctgaattagtactcagtctagtcacaagaacagatcatttaggtctcaggtctcatgcagtcttcaattaaaaaaaattaggcagatgtgtggatttaactggacacattaaagaataatgatgagtgctaggaaatatctactttgggatgttagaaccaatatatgtaactaggtcctgttaagcaattttctatggaggatcacaaagggcattactagtgttcactcaatgactcctagactggctctactgaggttttcctaagattctgaagtggaaagtatgaataaaatatggatcaataaagtatcttataggtactttagaggaacattaagtgaattgccttaggtcacaaaatcctaatggtgatgaaaaaagaacctgggactcccagcccctagcttaaaacacctaaagtacttcctcccatggaatacttcttggaggccagtttcataattaatttaaacagctttctggggcacattaattatgtaagctctctgtagactaggccactacaaaaggagaaaatagattcctcactacccatgaatgggactgttttcttctttgtgacaccaaggtgctctgaaagcccctaggaaggaaacagcacagtgcccacagggtgaagagcatggcggggtgagggacacagatttctcttctggctgtcttgtctcattttgtaggatctctcagtagtctaggaaaattgacctttccagctgtcaaagtccctccccaacagagctttatcaacctccgagggatgaatcccatctataaatttccatgcctaagggccctgctgtactggcagagagaatgcagtctagattccatctctctatgtggttaaggcagcattactcttctcttcccatatccatatgaatttccaatgtgctgcagtttcaggggaattaaaccacagtattgtgagcaatctcttaaatgatataatgatgaaacttaaaatatgaaatgttgtactattattgaaacaccgagacaaaacaagtacatgtaaagttggatgataacgtagcatctgattaggttcagaaaaaggaataatgttcttggctcatatgcgttgaagtctaggaccaaaatatggctttgcccacttaaactaactgaaactaaggctgactgaaactccttctctttttctaagccaaattacttacgattccccaaagtgtacctacatttttgagccccattggaattcattgttcctgccatttattcattcatgcaggcatagagcaagtatctattaaagccaactatgtgtaacacactgtcctaggtgctaagaatatagaacattgaagataaataagttcctgttcttttgaagttgatttctaatagggtaagacaggcaataaataaataaatctataaatatattagtacttaataacttgtaagaagcaagataaagcaaggtaagaagagtggtgagtaagtgtgtttagtcatcagagaaagtatttctgataagatgacatttgaacagagatctggaggaagggagggagagaaaggtgcatttatatggaggaagtgcattcctagcagagaagcaaaaggaaaaagtcggtgtaaatgttctgagaagtgtatgcttggagtgttcaaggaataactaaaaggccaggtggtgcaccagtggcaataaggataaaaatgataggaaaggagagcagaagatgcagtgggaatatcatacagggcagtgttcctcatacgccctgtgttaaagaactggctgtttttcaggatccactgcagatcgataattttataaaatgcaattaaaatgtcagtgcaataactactgctacaaaaagcttctgaacctgtctcctcacagacccatagcagttctcagaggagcagagatccaaggaccacactgaattgtactgagagcccagtaaggcagggtgagtctgctgaattttattctgagggagctgtgccaccactagaaggttttgagcagaaactgctgtttctttcaactggcatgcccttccctctccaacacttggcaagatcttgcttaatcacatgaaccatctccaccattgacaaagagtatcttcaaccaggggccctctaagcacttcacatgtgtggatcccgagtggatctcatggcttctcttccacccctgccaaaagtgatgatactcaattttttttctctttttcttctttaaaatactcttcatgtcctcaatatacaccatgatttttgagtacatgtcctatccatccaaacagtctataaactccaaatatcagagactattttataaatcattatacttattaacttgacactccataaatattcttgaattgagatctacactaggtcgacaaagatcagtcatcaataatatgatctgaccatataaaataatttttaaaggtctgtttagggctgggtgtggtggctcacacctggaatcccaacacttcaggaggctgaggcagtaggattgcttgagcctgtaagttcgagaccagcctgggcaacacagtgagacctcatttctattaaaaataaaaaaaaaatagctgggtatggtggtgtgggtctgtggtcccagacacttgggaggctgaggcagaaggatcacttgagtttagtagctcaaggttgcagtgagctatgatcactctagcctgggtgacagagagagaccctgtctctgaaaaataaaatataagacctgtttatagcattttagaaaatgctgacctttatcaaactccctgttactctgcagatcaaatccagaaaattattgctgcctcaaaggcttttgtagttcaaatctcttatctctggcatatttcttgaaatacatagtccactggctggaactgttgaccatcttagtgctatacagatctctcttctaatgaaatgtgttaggatgcagtttgaactgtagaactgaaaaatttaaatgttcccttaaaaagtcagtgaccaagaagcagcattgtttgtatatgtcccagacctatagttaatttttaaattagaagtaacgatctgctgtgttaaatgagtaagagaataattcaacatctggataagggaactgtaagatgaaagcccagcagcaagttgaaaatctgactttcagtattttagctcaaggaagcacggcaagaagaccattgctctaaaatccaatatgaaaaaagttcatgttgattctacctctatttttaccagcagaaacagagttggctgtatattcttaagtatttgtatctttggactaaatcaagatttactgtgatgaaattcctgatgtaaaaaagaacagttcctaatcaaagaatcttattctttttctcaagattataacttttttctttagacaatgaggaaaacgctttccttaagagtaagaagccaataagacagactatctaaatagagctagcagatctttgtggtagttttttttttttgcatggatagaaatatgttattttctagctgcaaagggacctccaaaattttgacacatactgttttaaaaggtcaacaacacattctgttcattactccatccatccatgcatccatccatccaaccatccatccatccaaccatccatccacccacccattcattcatctacccacccacattctcattatctccccctcagctttttctatctctatcttcttgtaatcttcagagtgaaacaaataatcttttcccctcacgatttaatgttttaaagcaaaacatacaaatgcaaatacaaatctgtatgcttttcttcctatatttttagattatctctcttccacaattttcctacttctgcttattttccaaactcacttttctccttttcctaaagttaaccttttccttctatatgtaactctccatttctttcggtcaacctacagaagaaaattgagattaacctcaaaactatcacccaggggtctgtgtaaagcaagaagaagacaaataaccaaagccttacttttcctggtctttctggaccacccaacccatggctgcgacttttattgatgtccccaatttgatggctttgaaacacagatttaaaaacctatcatcatatgaagaaaagcctataacaaattagagaaacacctactcttaaatgatttgctttttaagggcaggctgggcacagtggctcatgcctataatcccagcactttgagaggtcaggatgggagaattgcttgaggccaggtgttcatgaccaggctgggtggcatagtgacaccctatcttaaaaaaataaaaaataaaaagttagccaagtgtagtggtgcatgcctgtagtcccacttacttgggaggctaaggcaagagaatcacttgagcccagaagttcaagactgcgatgagctatgatcgcaccactgcactccagggtgggtgagagggtcaattgtcaggtcaactgtagaacatggtgactatagttaacaatatattctactcttatagtcagaaagaatgactaagacctactaattgatagcacaacagggtgactgcagtcaataataacctaaatgaacattttcaagtaacttagagtgtaattgggttgttggtaactcaaaggataaatgcttgaaggtatggatatgtcattttccatgtgattattatgcattgcatgcctgtatcaaaacatctcatgtaccacacaaatatatacatacctactatatagccacaaaaatttaaaaatatatatactgtactcttgaaaaatgagtaagagagtaagatgtaaagtgttctcaccacaaaaacaataatgtgatgtaatgcacatattagctagatttagtcatcccacaatgtatatatacttcagaatatcatgtcgtacacagtaagtatacacaattttatctgtcaatttttaaaagaaagaatagggcagttatttcatattgtatattttatttattttttatatcgagacagactctcactctgttgcccaggctggagtgcagtggcacaatctcggctccctgcaacctccacctcccaggttcaagtgattctcctgcttcagcttctcgagtagctgagattgcaggcgcaagctaccacacctggctaatttttgtatttttagtagagacggtgtttcaccatgttggccaggctggtctcaaactcctgacctcaggtgatccgcccgcctcagcctcccaaagtgttgggattacacatgtgagccatagtgcccaatctcatattttattaaaagcccatgaccaaaatttgatgttcctggacagaaactggtgactcttgactgaaatgacttaataccagaaaagcgtgaaactttaaaaattagcatcattgttttcactttaaatttaaaaatctataatttaagcttctaggagttgtcattaggcagggttaggacaggcaaagtgtaggcaagggtcctacgaaagatttcaaatatacttgttatgtttgtttcttaactggttggtagagatacacagtgctattttattctttataccttacatatgttataattatcttgtcaacatctaatatataataaaaacaaaattattaaataccattctttgaaaataattgtgattgataatgttatctgtttggaaaatggcactttaaaaacacccatttttctaaggtgcttttaattaaaaataaatgcaccagaaaactacatgtcagttgaaagaactttattactgataaagatacttcacaactttctgtagggttatgagtgagtcatatacgacgggtactcagtgaatgtccttgcagccaaatacagactgttgagcagggaacaaaaatcttctatagaaagacgtgcagaaaagtatttgtttggtattaaacaacactaaattttcaattctatatgaagggaaaaatatgacactttattctgacgtaaatatgggaatagcaattgggaagtaacgattgataaaagatggaataacaacaggtatcacatacttaatctcacttatgggctatagaaggaaagctgcttaaaaattcagcatgtggttcactcaaatttaagcaaaagaagctggtaaaatacagaaccactagttaaaattttacattaaacataccttatcagaagaccaagggggaaatgcatgctgttgaccagataaaacagagagtgacagggaaaatttgtactggcaaacagtgaagcaacagaagccaccactgagatagaggagaagaaagacagtccccttagaaatattatctaagtcaggaagataaacaggtagcgggaagactcaatgagacatcttttggcaggcattttatgcgtcatctcaacgaatcctctcaaaactacaaaatgtagatgttattatcctgtctggacagatgaggaaattgtagccccacgaacttaagaatgttacccacagagacacaaaatgacagcagggattcaaatccagagattttttactccaaagcttctcatttttctaccgtgccactccaagaacagaaaaatctacaaaatatagttggggtggagggaagagaaggcaatcatctgcccctcaaaatggtaaaactaaagaatacaaagattaaaatttgtatttgagtccttactgtggccattattaaggaaacctgaaggctaaaataagcagagagggcaaattaatgtgaagaatccatgatgttctcggtctaattgacatattggacataaataaatccccaggagtggttggaatacacttgagagtctcaaggaactttaggataaaacagcgaaacatgaggacaaaatgtacaacttgtcgtttacaaagttatctttcacaaggagtctggaggatgtttagaataattctaacacagaatatggctgcagaggtctaggtcagtaacctgaactttcatgcatggctggcaagtagaatctacaagtacagtgctctagacacaccatagaaactctgcatctctcgtacatctttctacagtggattgcagttatgtatgtacatatcttatcacccctaactagattttaagatgcttagcaagggctatttctattcatctagtattccctgacagcctggcacactgacctgtacttaataggtactcaatatttcttgaattgaatcaactcctcaccacataagtaagcaccactgctgggtagaaaggcaactgtggcttctgttgggggaaatactgcttcactcatctactagaattcaagaggctaaaatcagtttatggccaagaggaagttgtgacatacctttccaagtgaattgcatggtgattggtgaaacgtttgatcaagggaaggaaatcagttcaaaactataaacaagaatcaaagataaaagtataattcttctaaatgaaaaggagttaacatgtctctgttgcagctgaccttaattaacatgtttaacatgtaaataatttggctgaggaagccataaagtattccagactgtgggtaagtgtcaaggtgatgagcataaatggcaaagaaaatggcaaagagttgagtgaaatgaaaagtgacagatacgtatcattgaagacaagtacaaaccaatgattaaaatacaaaagcaccatataggatgatggactgtgtgccattagcaacaatttggggcagtgatgaaggcacttaagctcaggtatcttgtaaagatacaagacaaaaacttccaagtatcatgaggcagcatttggaaaaacaaaaggtataattttccctttgcactaaatccaagttctttaactgtggctgatgacaacacacagagtaagacaagatgcagagagacacatctaaaggcagggctctcaacctccatggtctgacattatgggccagataattcttggatgtttggggctgtctggtgtgttgcagaacattcagcatcatccctgacctctacccattagatgccagtaacaccttccccattgtgacaaccaaaaatatctccagacattgtcaaatgtcctctgggtgacaaaatgatctggattgagaaccatcgctttaaaatgatcagcagactctgcagcaggagaaggaatcataagcatatgacagaaataaacataccatgagacagttggggcaaatatgcatatacttgccaaattccaggtctatgggtatagctgaagggaggcatttttaagagaaaaatgataaagttattactaaatagaatgaaaatttgtgaatttaattttatcccaagatgtaaatcagggttgaaaaaaataggtttaagaaatgtttggtaatgttatgtgttgacatactccccagttttttaatgtaatctcttatagagcaatgctgtttctccacagaacatcccttggtgcaaagagagagaatatcaatatagtctgatgtggtataaaagcttaaactgttagactgaagtcagttgtattctttagttctagttttgaagtgttatttctattcattctgaatgcacctaatctaaatacagaaattatttcttgtgtgaacttcgccaaatttgagcacggacatgaagatgaaaaggaggtagagactgggttcatgcttctgacaggattattggtaacaagtgctatcacactggaaagactggtacatgaacaacaggatgtaaactgtttgtcaatgctaggatttacagtcatggccttcgtatgttactacttcattaaagggccactccatttcaaagcctacatgccaatttggtctccctgccacattgctttatggccttatctcactgtgctgaactactgcattgcactggaaactttaacattatagctctcgcagtagttgagaatgtgagatttgcactcaaagcctaatttttaccatttatagcctgtgtgaccttgaccatagtatatgatccttctgagacttacttttttcatgtgtaaataaaagtgttaataatgaaaatctcagcactgatgtgaggattaaacaaagttagaggttggaaccctgctattagaattggtgtaggttgggaagaggggtcttctggccttttgcttaggaattagggtctggaatgcagactgttgaaggattaggcaatgctgcgattttcttgcctgtttctactttttcaaacataatcacctgatgaaaatacgtgataattgttttagaacactattttttcccagttatatatttctagcattcactcagacatagaacagcacgaatagcaagaaacctactaaaatctctatcaatgcataagaaagaagatttagtatcagactacctagatccacattgcagtactgcaacttattagttttatgggcagtttgtgcctcagtttcctcatctgtaaaacaggatattacctaccttatagggatgtgtaagattataaaataatacctatgaggtgcttaatgaaatacctggcatataacaaaaactcaataaatgttggtatcatcatcatcttcttcatcttcatcattctcagttcaagatcatactgggccaagagacaggaactgatgggcagtggatgcctactccatgctcagcctaaagggtaaagactgcagagttaagctgatttatttcatctcttctgataatattttccccaatctccatattatgccaggtagggattttgttgagagagacttgaaactagaataagattgagtaaggttgtgctggggcaagtggtttttcttgacctatataaattggtacagagtttaacatctcagcctggaggcagaaccgagtactctatcagctgactctagttttgcttttgggcaccatcttcattgttgtggccagccagacttctgtttgtcttcttttaatacaacccagctcatacataactgtcaagttttcaaggtacccagcacctttttacacccttgctatatttgggaaatttgcagccttcttgatttggcttcctaacagcagaatctagaaaactcaagttccaagactcccttccagctaggatacatgcacctgcaggaggttttgccagttagtcagttgctcctgaatctttggtttggaagcaagaaatctaagaagacaagctttagggggagtcctaactattttgctggcattggtggcagcagaggcatccaacaatcagggacagtcagtacagggatttcctttatgttcatcaggcaacagcacaggttgcagttttttctcatcagaccagttctaatgcatggttctaggattgttcctgtaagtttacactcaactgttcctatattaaattccaaccctccctgacaattctgtgagctatagaatttatttatttatcctataataaaatctcttcctggctgatcaggcaaggtttgtgtttctttcaactaaaaatctggatatattccaggaagccagggattcgtatctactacaaaaggtggtacaggcaccaaccagtaacagtaaaatatatataaaaaaacatctggtgcttcaaagtgacagttgctataatgatgcctactctaaatgtgtaaatttattctctaaatttttcaataaatactgcttctacggaaaaggaaaggctttgttcaggcctttggagccgacaataatgctctgtcattaaaatgtcaagtttaccttatcaatttgtccagttaactatgctgtgaaacaaactatcccaaaacttaataacaatgatattattatgctcacagacacagtgggtcaggaaattggatgggacacagaggacatatgttctttctgttccaaaatctgagacttcatcagggaagaattgaagagtgacttatggctgagttggaattatctggcaatgcttctcactaaatcacatctgttgcctgggctgataagactcaaagacttggcctactcaatagagtacctacaggtggcctctcctgtcttggctttcttacaatatggtggcctcaaggcaatcagatttgttacttggtagctcaaggcctagggcaagtatcccaataaagaagggggaagacacattaccatttatgacccacctaggaagccatgcagtgataataccagcatacttctatttgtcaaggcagtcacaagaggagggaattcaaaaggaaaggaattagactctacctcctgatggggaagtggcaaagtcacactgtagaagagcatgtgaggtgagagatactgttccatccatcttcggaaaataaagtctgccacagtgatgctggtaaaattgatttagaattcaaatgttcatcctaaagatgtctaggagttgcagaagttcagacagccagagtactttaagtcttgatactatcaaaatactctacatctcctatagatctcgaaagggtatgcagacattctcaatttgcattctatttttcagccatcagtatataatttgactatggaatactcatctagaaaacctggtgactatttatattctgaatactaaaatcttttagttacagtcaaagctattatatagtttgtattttcttccagcttaccacaagtccctggtgctatgactcctctgcaaaatagagatctcttgaaaaatcttgcatttgctttcaaagcactgtcataaatataaaatccttttgataaaaggatttttatcatgttcatgtatttcctatagttttatagatgaaagatggtgttgataatggcataattttgatctttcccactgagcagatcgttgcagctgagttttcccttgtaaaattcaattacgtttctctacatcttatcatcactgccaaaagatgtactgaaatctttcctaactcccttctggcaaaaacaagttctgctacaaagggtctcttaagattcttgaaggacatctgtcttcatcagcatgtgatctggtggagatacgtgctgttttaagatacaggttcatcagttattcttttggcaaatttaaatgctattactgtgtgattgcaaaagtaagacctgagagctattagtcaaagtaccaatccttttcagaagaaaatatacccagcatcttttaaaatggaatgtgtatttgtttttcaggccagggctttggacttatccatcgattctgccccagtacatttacataattgttgcacaacaagtgtctgttgacgacaatcttatgattatgcattgcttccattaatatatagttcatataccacagtgctgattctttttatatctggcaggttttagattttttttttaacttctgaagacttatgtttcatgatatggtgtattagtccattcttgcattgctataaagaaatacctgagactgagtaatttataaagaaaagaggtttaactggcttatggttatgcaggatgtacagaaagcatagcagcttctgcttctggggaggcctcaggaaacttacaatcatggaagaaggcgaagggagagctagcacttcacatggccggagcagaaggaagagagagagagacgcggcaggtgctacacatttttaaacaaccagatgttgtgataattcactcactcactatcatgagattagcactgagatggtgctaaaccattcatgagaatttttcccccatgatccaatcacctcccaccaggacccacctccaacactggggattactgttccccagtgggaaaaactgttccatgttctgcatgatttaccaaacgttccaccattccttcaggtgttaaactctttctaaaattatctcagcttacacattagcagcctttgtacattctaagatatattacatttcatgtatacataccctgtatgtatgctataaaagtcaaacccatcagaattggtagtaagacacataaagataggaaccatgttttatattttcttcacctagcacagtgcctcatacaatgtaggcatttaataagcatttgtaaaatgacacaattattaaataaagagtgataatatatcattgttaggtcaccttgtcttgttcattcattatctcatgaactttaacagtcttatcctaaaaataaagttggtaataaacacattgttacaaaatgggacctcagtttcttcaggaaataattggttcacatcctgcactgccatcatcagaaagaagtccctttcaccatcaaaatatgtaaatttgagctaggtttccagaaatgattcttgattgtattaaacaattggatgttctgcactgatgttctctgttaagtgaacaggaagtgacctggatgaggttacatagctgcaaaatcccatcttcatgcaagttcctttgtggttgctagggctccatcattccacaggctgcttcacaaacatccaccataaaaataaagcctggtatcactgctactcagtcagtaattaaattccatgcacatccagaattttgcttgtatgtacattttaataatgaggttgtcttcaaggctgttgaaaggtggtagaagacttcattgcttaaccaaaatctgccaattatcccttaactttgcagttttactaagatcaatcatccaacatattgtggtgctttaactggttacaaattaaacagaaaaagtaataagaaaagaaaaccaattttcctagactaccttaagcctgccaagcataaaaatgcacttaactcagaaaactgctgagagattaatatagaatttgtgtgctactaaagaaatcattaaagcagctaaattctgggaatacagcctctgcaaaagtaagggaaatatcttattcaaaaatagtggtacaattaaatttagttatttatcctgtaccaatgtaaaaaggattttattagtataacttcatttaaagccacatatgcaaatcttcagagtgaagaaaagatttcaactgttaggcaatttaaattttagtattagacaacaagaaaagtatgagcacttaaaacaaaaaaatctgcaagagcgataatgaggatcaaactggaatgaaaactacaaaatttggcagcttgaagaaaaaaatttatagttaagttagaaataaaatttaaaataaagaacttgaattttatctccagtataattctttactgtcattcatggttgtcatgattattgttataatcatcttcatagctctcctctaaaaaatgcttattctattacaagcactttatactcattttctaacttaatcatcaaaacaaccctatgagttaggtactactactcttagtggagaaactgaggctaagaaaggttaactagcacacattactggcctaaacctagtaaatgacaggttaaaaccccaggcagtcttattccacatttcctcataattatcatctgtctagatttttttgacaatagatctgatgaatatagcagctacagacatagcaaagctgtcatgcagctcatgagctgcatgaatcttaactagttgagtgactggtttcaggtaacaaacttttctggttctcaaattccttaaggaggtggtaggactaggatagagatgcacaactggggcagcaaccaccagggagcaatgtgtccatttatgggaaggcaggatcacaatgattgtggaccactattgtgggcatttggtaggcaaagttcagtcacagaggtggaaatgagtggaacaattccatcaaaggaaaaattttttcatgttctgcatgatttaccagatgttccaccattcattcaggtattagataaactctttctaaaattatctgagcctacatattaacagcttttgtacatgtaaaccccaagtatttttttgttttgtgctattttaatatatattgatttttccaggaatgcagcctcaatatgcatatctgtgtaactgtgtgtgtatgagtgagcttgcttcatttggaactttatcaatgacgggttaccatctgggaaaatcatagcattgatataaggtcaattacggcatctgagttgccaatacaacacacctgtaaccgacagcatttgaggctgccccattcatgatgattctacacacatgtgcacacatctgactatttcattaggtcttccaaagaagtcatgctttaagcatttatatattgatattgacatatgtatatttttatatatcttttgtatttcagtcagggtgttaaactattgatttttgaaaatccatgtatgttgatattgttggtaaaatgtattttaagtcactaaaaggcagtgttattaaatttttgtcaggaaagggtgtaactgttctcatacaataaagaaattctggaataggtaatatctaacatctcatacaattttaagattctatttcaccttattaaacacagccataatcagtgatctttctccacaaaagtgattgcagccaaaaatcaaaagttaattacacattacctcttacttagcattattgctcacagaacacacacttatatttctggaaattctctaatttgcacattttttataatgggaaatgtctttccaagtctgtgaggcagaaaatagcattccacatacaccccacatattcattctttcctcttatcccacacataaaacatatctggcagaaagtcagattagaaaatggaatgggactatgcttataaattcattttaagttaaaaataaaattaaaaaatgagtgaaaggagtcacaacagaaacaatggatggaaaatgaaagaagtgatgcggaattaaaataatttgatcattctatactgtgggccaacattacagaaatagagaattataacaaggtatggtaattttaactcaagaaagacataaggtttcctctgctttgccatgtagaggagtcagtcaacaatgattaagcaagagttcagaactctttacaaagggatatgaatggctgttctgaagtcccttctcacattcaaattcaagtgattaaacaaagacagactgagcacccactgaatagatgggctgaggactgggctggctgctatggagtgggatggaagtgagattcctacactccatgttcctgcaggacatacacacacaaataaatctgaaataaggatgactatgaaacaagttataagagagatagtaagtgctaaaggaacctggaagagggaagaagacttatttcaactaggggaaccgagaaggctttttggaagaggtaggatttgagctaagcttgaagaaaaagaagagctttcataagcagaaatgagtgtgagaggggaggtactccaggaagaagaaataactggaaccaaagcctgggagaggagaaaatggagggcagattggagtgatgatgttagggtggagaagggagactgcagaggcaggggacaggtaggggagaaaataaaggtcaatgtgaaagccacactgaggagttgggacatattctacatattcaacattcattaaaccaatgctacaaagcacctactatgtatcagactccgttttaggcagcagggaaatagcagaaaacaatgcagataaaaatccctgacctcatggagcttacattgttagctggtaaactacagaataagataaacaagaaagaatatataatatgttatagaggaagaagtatcgcggagaaaaatgaagaagggaagaggaatagaggtgacgcaattttagaatgtccagagaaggccttactgagaaggtaacattggaacaacagcttgtaggaggtgagaatctatgtaacagggattcaggaacagatggtgaacgacttacagaaacagagacaatatggacactgatttgaggggggcattgaggggttggtagctaggggcagggagatgaagcagcagcataatgcattgcatactacataatgtttatgattcccagctacacaggaaatgtatacaatatgtatatgaatgataaataccatgaaaggagggaaggaaagtgaaaaaggtaatataggaaagtgtcctcaggtggcttttactatcttgttatttttgttcttaaactggggctgcactcataggtgtttgctgtgttaatctctatttttatttgcaagtctgaagtagcttgcaaaaaggaaaaaaaaaagtggaggcaacagtttaaatagtttacatataattataatttactacataccaggtgcttagtgctacacaggaactccctcgatgaatccacacaacaaccctgtggaagggggtattatttctatcattcatttataggttaaataaataaataaataaggcacagagactacgtaatttggacaaggccacatactgagcaaaccaagccacataggctacaaaccaaggcagcaagactccaaagaccatatgtgaagccactctccaaacagcactcagaatcgcctctccaaaaataaacaaaagcttcagctggaggaagctgaacagcaaaggagggaagacaaagatagtaacagagttaagaggcactgtcaaggcagaatgaattgaatggcaactagttataagattcattcattcactccttattttttcacggctcaacttgcagtgcatattttttaaatttcttaaaccgtatgtgccagtcactgctgtaggtacaacagtataagagtagataaggcagagcttatgggcaattgaaatacagtataactagcactataataaaggtatgcaaggagggtatgggagcctatggccggcatgtctaaggtccagatgccagagtcaactgcagtgtaagaaagagtgaacccaattaagcagaggttgaggtgtctacacacagtaggcagtgttcatgctaaggcctactgggagaaatgcaagtgattaatattgtgcaggggcgagaaggaaatgagggtagctgatgatgaggcacagagagtaggtaatttgtacaagaccagatagcttgaggttcagcagaggtcagcccatgacagccagatgtagaatgaccagccatgcaaagaagggaaggagcaaaggaccgatgtgtttaagagaactgagtgcacaaaggaaggagcagatggagcccaagaacctcactaggattgtgggtggtaagatctgctaaaaaaagggagttggggggatgggtgaaaactttaggataatgtcaaatacagccatgttaattaaagtgacaggaaattaacaatggattcaaaagaaatacaccatgctaaatggaggatgtagtagaggtaaaatgtcttgacgttgagttcattggtcaacactcacattggtcaatatcatgattgggagatccctgtcactcctcaacatgtgggtatgggagcagagagattgcaggcataaccagaggatgaagacagagtgatggactctttatttattttaaaattatttataaggattcaatggctagtactaagaaacacagactacattgtttccaacttataattggattttataataaaattggaatagagcaaaggcacaggaggaaaacaccagccatggaaaatagtgggaacatgacatgatatgtataagcattcatattaaccaaagattagtcaaatgaatccccaaagactgctgaactgattaaccgacctgtacatttatataggcagacccttaaaaatcaaacatacttttgttaatgtttcctaaggttcatttaatctgtgttccctagaaacacaatttccaagtaagtggtgaggtgaatgaggaaaatatctctagttctcaccagtcagcagctcaatacttgaagtcaggttttcaggtagaatttctgttactcttctgttttttttttttcctctctttcaaataccaggtgtctcaggtaagtaataaaaggaggactaaagggagttttcacttttttcctttcatttattaatttctgcacatatttctccaaatggactatctaatgaatggtaaacagagttcctttaaagaaaaaggcccagtggacagaaacgctacagaaaaagagagaaaaaaagagaaaaaggttttgtgtatggtattggagggtggcagtgtagagcttcctttttttctggacgctaataccagaggtcagttttaagccttagtttgtaaagatgcgatgtgaggttcacaagggaagtaaagggtaaaaggcttaaagcatagctggagaagctgaagctgctaattggctctaatgatctgaatgcaaattaataaatctctgtgctaaaaattacatgcacatataattatgacttttataacttaagagctctacttaacccattattcacattctttctttcctgagacctggtaggaatggataactttttttttttattacctctccagcttcatccatcacatgcaccattgagctttacagcctttgaaggtcttattaaaacaatccaaggattgcagaaatgaaactcacagacattattacaaaggagggggaaagggtcaagctcaaggctgtggaaggctgagtagcttgaaaatttccagcaaagttatctacccaggacccttggactaggcaagaagaaaaatctgaaatcacaatatgtggctgtgggctgttgggaataaaaagacacataaaaagaaaaagaactcagctgtaacaaaatggccagactgcattttcttccacaaagaatggagcagttgtcacaataactgagataattaatattaagaggtttaatagaatgcctggtacaaaccaagtatttgaaaatttcctttcagtcattcagagaggtggcatctaattcctatttctagttcctatgatttcactttttcctatcccctgttctgtatgttcctctctactgtgtacttgctcctttcttttccctcccatctccatctttctcttctcatggcttctatcacatgaataggcaggcaaccacttggttcctctgtcattaaacattcaacagagactaaacccttgagccctattgcccgtgccccatgtaaacacatagtgtgccatcacaaaaaaaaaaaaaaaaaaagaccactcttctatcaacacgatgttacagcatctgagccaatgcaatgctagggataattttaaaaggggactttgcctaggaagctggtagatggaacagtgtacacagacagaagactccaagatcaccagagaaaaactggatgcaaactaatacctgttttgtacttgagatctgacaagtgtggaacaggagaaaaaagaggtaagaggagccagccgagctgaaccgaagccaattttagccaattaaacagctctgatcttgagtaattgcttaacttctctgtgcctcagttcccttatctgtaaaatgagactattgtgagaattaaatgaatcagtacatcagaagcagtgttaggaacatattaagggatatgcagtcatacaaataaagtattatctgcgagtactaccaccactgccatcatcatcgttttatttcaagacaagtccaaaccaaatattataagcattaatattaatcacaataataacattctgcttatttcatattttgcttttcagttccaaaagcaccttccccatggtctccttttagcttcacagtagccctgtgggccagaaggattattatctcctcctcgcagacaaggcagacaaggcagccaaggctgctttaaatacttggtctgctctgccgttctttgcaaggttcataaccaaagagacacctttagtggattctggctccagaattggggaagaaaaaccacacaagcaaagtaagaaacaaaactgggaggaaaggtctttccctcccacccctcacattacatccatctccaagttatgagtctactacccactctgctttgttcatttctattctctccactccatcctcacagcaacagcccttatcacaggacaactgcaactaccagttaatgtctctctggtctcttcccacatgaaaacccataatgccactctcctttggggctccctcatcttcccctttcacatttccagtcgtgatcccattgcaactgtgcacccctttccctttagtactgcccattccttaatttttggccttagtcttcacactagattataaattatttgagggcatggatcatgttttttcatcttcattttcacagtacccatcaaaatacccaacccatggtgctcaataaatctatattgaacaagcaaatgaaaactctataatataagtagagagggactggggtacagccctgaccatgtttacattgtattacatcagtagacacattcatggaaggctgccccttctgagtgaaaactgaatctgattagagactaaggactttccaaacttggggaaaggacctaaaaaggacccccaggttcctcctttagtgtctcaatgatcaaaagctctcccttgagagggtttatagttagggtgaacatacgtcctggtttgcatagtaaagccctgatttataactgtcatcccgatgtaaatagcaacagtgtcccatttcacaaagacatccccgtttggacactatactacatagtggagaagagggcagatcgggtttcagctctgttgctttccagctgtgggaccttggtcaagttgttcaacttctataaatttctgtttttacatctgcaaaatgggcatctacttcacagcattataaagatcaaatgagataatgcatgcaaagtcattagcataatgcctggcacattgttcaaaaatattagctactatcactgaattagagagggtgatcatgccagtgcacatgcaagtgtgagcagaaaaattacacttactaaatgttagctctccaaggcattctggcaacaaattgatcaggtttttactcaagccatatgtgagtgccttttgtttaacattacaatagcagttttaagagcacagaaatggggaaatgcagagcaaaaggctgcatgcttaacctacgtattttgttaataatttcagtgagaccgcttagcgcttttgctagcaacagggaactgagatccgcacttcccgctgctgtgttagaactcttgccagccacaagggaatagagagctatttgagaaattgccctctccagcctctaataattatgtaaagcgtatcatcgaggacctgtaattggtacagaaggctacggctagaaaacgagactattactctctacaatcttcttaggataaatgatacatttatcttaaaggaaagagaattgtaatacgcacgaacaggatgtaaaggaaagcaacttccttgaatggaggatgcagcttaagatattactattcagcagaactgacaccaattggaaatgaacaataatgaaatgtagaagttacaagaaacaaaagccttaacagaaaaaaatgtaaatggattataaaaagagaagttgcaagtttcacataaagtttagtcttggatacaagacctacccaatgattacccacaaacaatttcttgggcagaaaggcaaagcagaaagaaacaatatataaaacagaaaagaacaaaaaataatatgacttacacaggtgtagaagaatattttgaaatgccatctaaaatatatataattcctggcaattttgtctcaaaattctccactctttgaagctgaggcatccatttcttaaatgagaggacagggccaggaaagaaaaaagaagcttttgcccaccttggacttcaaattagaactgtttctataaggactatgaaaaccttgattttcccttgtaagagctgggcacttagaggttttctgctgaactccaaagatattatttaaatagcaaaatgagcctgaagaattgactatccatttctccaattagcctggtggatcctgcaaactgagatcaaaaccccagaaggggaggcagaaactttccagagactcagcacccataagctgaggagactcatgatccctgttcaaccgaaactctcagtggtgcctcacgcccacgaaagaaggctgccacagagaagaaatgccagtgggcgggtctcaacagaggacaagctgcccccggtgcgcttcacaccagttccccttggcacctgcagagcagggaggggagctggaacatcccatggccccttcagagaggcttagaaaggggctgagggctgccggccaatgtgctattctctcaggatggtctgagacaaaaaaaatctgtagcaaaggctgtgagtagaacaaagccaggagtagatggagggcgtacctgattctcagagaaaattcagcaccaggaaaaagccaacgtgatggtgaagtcagcagagacaggcctatgctaagatcagatcacagatcacagatcacggacactttaagtagcagatggggtgagggcaggggctcgtgcctgaagaccaggtgggatgagatagctcagcaacagcaagaacaaccagatacagctggtaagcctgccaatctctctcctctaaagcctcaagtctgcataatcaccaagccgccttgccactcaggaggaagaagaactctaaaagcctctatctttctgcgaaagaagagtgagtcagcctggaactgaccttgttaccttgaatgggcaaattacaaggaaatggggaaatggagattcaagagctacatggaattcaggtatacaaaaattaagctatcatatgtgactctaagttaaaaatcctccaatacattatacagtatatccaagctatgaaaaatttatgggtgcagtggttcacgcctgtaatcccagcactttgggaaaccaagttgggtggatcacttgaggtcaggagctcgagaccagcctggccaacacggtgaaacccccatctctactaaaaatacaaacaaattagccaggcgtggtggggcacgcctgtagtcccagctagttgggaggctgaggcaggaggatcatttgaacccgggagttggaggttgcagtgagcagagatcatgtcactgcacttcagcctgggtgacagagtgagaccatgtcaaaaaacaaaacaaacaaagattatccccaaatcctatataattgaggcttttaaggtaaaaatgctcatgagaaacataataaaatgactaattttaaaagtgaaaaactgtgcattataattgataaattaacaatgatctcatatcttggaatgttcctagatttcaatttctgcatatccctgaagcccagttacaacctgccccatctcttctctctctgcagtcaacattttctttttgaaagcaaatctaactgagccgtttccctgttgaaaatgctctcatattcccaaatgtaaaatctcctaacgacccataagaggagactcctgagctgggctcccatctacagcacccattcatccatcctctaccaaccctggacacgtggaaccacttttagttggtgacagtactaagcaaaaataagataataacagtaacaataagagcaagataaaattaattttaaagattaatatctatatatcatcataccacaaaaagcactccctaacaaataccttatttgatcatgacaacaataccgtgaagaagtgatggcagatactgatattactgttgttaattactgttattactattgctaaccctattttatagcatataaattaagtctcaacaggtataggaatttttgcaagatcacacacctaagtgagagctatacgagaggtctatgtctccatgtgcccttttcactctatctcaccatctcccagtatcactctttagataaatgaatttcaaatctggaaagttggggaatcgagaaagtaaagcaattaaaactgtggtgcatgaaccacttgatcttatgctttgtttttctggctttgctaactgcgtcagtgtaggagataaagttgtttgaagacttcgccttctggctttgccttaggagtaaaacaaattttaatgaaagttagcttttcaaaatatagcagtattaggaaataagaaagactgctgaagcatagaaatgtttgaaaaagaaggattaatgttcaaatcataatgcctaattataatatttacaaaatatttataaatgcaaattttctccctgtgcctcaacgtcctcaggggtaaaatgggattaataatgtacccactttacaggttgttatgaggattgaatgagtgtctgccttaaggcacttaaaatactgcctggcatataaggagcctattaatgttagtactgttatcatttctagtgacataatcataaactatagatatctccatctaggtcttttgtgttttcttttctagaggtcaagaatatttacaacagatatttatttgaccttttaagtaatttgaacattctacacatgctttgagagtgtttagagtatgtctcatgtatttctattctaaaatacaaaatctcttaagaaactaacctctaagaaatgattataagcttacacttttctttaaaaactttgaagttcaatatactaaaagaaacagagaggtggatcccatgttaaaagtgcttttccttagccagagaagatatttattcctagatgcaccctccaccaaaagagaaaaaaatgctactgtagttaaatataaattaaatttagataacaataggcccagatcagcagctgtctgtccttggtgtgcatcaaaatcatctaggcttcaaaaagcttttaacaaacacagaaatcaagttctaaccccggtgattctgattcaactggtcaggggcacaaacctaagaaatgacttttttattcatttttattttattttattttattttgagacagggtctctctctgttgcccaggctggagtgcagtagtgcaatcaccacttactgcaacctcgacctggggctcaagtgatcctcccacctcagcctcctgagtagctggaaccacaggcgcacaccatcacacccagctaattttttttcatttttttttgtggagatggggtctcaatatgctgccccagctggtctcaaactcttagactcaagcaatcatcttacctcagcctcccaaagtgctaggattacaggcatgaaccacagggcctagccaagaactgacttttattaagatagagtctctctctgtcacccaggctggagtacagtggcgcgatctcagctcactgtaacctctgcctcctgggttcaagcaattcttgtgcctcaggctcccaagtagctgggactacaggcatgtgccaccatgcacagctaattttcacattatttttagtagagacggtgttttgccatgttggccaggctggtctcaaactcctgacctcagatgatttgcctgcctcggcctccaaaagtgctggaattacaggcatgagccaccttgccctgccagaactgacatttttaaagcctgtttaggttacaggaatgtgtagtcagggttaggaaccacagatctagagaatttcaagttcctatttttgctaacaggagctaaaatattgtgagtttataatatgtttttctactgaacacagttgctatcatcaaatgtgaaaagccacatttaaataaatcaaatatcattgaataaataaataaaaataaataaattcaaatctgagtaagagtgccctaaaaatatttgaagactacatttaaataaacattttggccttttataatcataatgggacattaataaagaagcaatgctagaagacagagttgaactacaaaaaattgaagctctaagaagttacatgatttgtccaaagaaataaagtcagtgccagagtccagtctcaaacttatttttcctatctgccacctttctctattgtaagtctagttgtttgtctgtgcacggatgtggtacatacattcctttttaaaaataatttcaggccaggtgcggcagctcacgcctgtaatcccagcaccttgggaggccgaggcaggtggcttacctgaggtcaggagtttgagaccagcctggccaacatagtgaaaccccatctctactacaaatacaaaaaattagccaggcgtggtggcaggggcctataataccagctactcgggaggctgaggcaggagaatcacttgaacctgggaggcagaggttgccatgagccaagatcacaccattgcactccagcctgggcaacaagagtgaaactctgtctcaaaaacaacaaaataataataatttcaaagacttttggagaactataatccaacattgcacattattaaggttatatatgttgaatattttaagatttgtttataaaagtcaaagtaactatgccaaataatcagtggtgtaaggtaaaattcattccttgatcaggataaacagctaattgacttccaaattttgatcaaagttaatatcaattttcttaagctcatagtttattctatttgcataattttaaggcttaaatgtgtaacacaaatgtcatcatgtgttaactgtactaacctgctatatttcacatcattgaatttggagctacatttctaatagtaataataactgccactgatcgagtgcctaatatatgccatgcattgtactattttacatatatggcctttagattaaatttcatagagaggtaaacggaggctcagctactgtttttttttgttttttgttttttttatcttacagggtctcactttgtcacccaggatggagtgcagtggtgtaatcacggctcaatgtagccttgacctcccaggctctcaaactgtcctcccaacagcctcccaatagctgggactacaggtatgtgccaccatgcctggctaatatttacatttttagtagagacagggtctcactatgttactcagtctggtctagaacccctgggctcaagcaatgttcccacctcagcctcccaaaatgttgggattacagttgtgagccaccacacccggccagctcagagaacttaaaatgctcgtgaacatagccatttggtggcaaagtaaatttccgatccaggtcagttttgctccaaaggcaatgcttgaaccacaaacatattttaccttatgacgattagaaatctaagcttaatcttattgaatgcaaacccaactaaaattaaaacttttaggtaaaactgattttaactataatttaggtttaaaaaaattgcctgtgaaaacactgatgctgttaacatgaacacaggtgaacacaagtcaaaactggataatgctgagtaatgctgttaaagaacttacttgttagtctgggtgtcagagaaagatgacacaacattcgaaagtactacagctgcaactaaatactattctctgctcagtatcaaatagttagcatcagggaatataaaattaggggaaaaaagaatagataaaattttaataaatgtaaataatcataactggaacacaaatgagtttattatacatactgatgggttaaccatctttagatctgaaaaagaaattatctgcctaaagaagaattttagcaagagggtagagaatgtgacagggtaacaggtgtgctgtgtctagaaagaacttcattaatgccagaattgaaacacaggctgtggatcttttatcttgcaggatcaccagtggatgctcaatgactttatgaggtcttcctcagagacttaacatcacagagaacatatggatttgaaagggaaatggggaaagtagtaaagtgttgctatattttaatgttattctaaaattacatagtgcatttaaacagcaattttataattgttataaagtaactagaagtcatgtatacttcaataaggaatttgtcttaatgaagtaaaagtgaaaagatctcaaagcaaggtaaagcttttatatttttttccaccatgaagatttagtccatatttagacaagcactagcaaaagtcccaaccattttggagataatgtcaagaatgattaaaattcatacaaggccttgcatagccttactatgaaatattaagtaggttgcagttgggactcaatggtccagaacctctcaagggctcaagttttgcgtatcaagaacctagcagagcagctacccctgggaaaatgttcatatctggccacaaagcacatactttcagaaggatgggacagtggatggcctggctgcagtcaggaagtaacaagaaaggatttctctcccatctgaaggttgcaccagaaggatgtgggctgatgtggtgattttagaatgatgaccgaagaatacaaagtagaagaggagtatctgcatcctcctcatcacaggggctaaacactgggagggatgagcctctgtttggtgtttccctccacagagcattgaggtagccatgctccttaaagacgacaaggataaaaaccataaaattaaatcagtaggaagaaaaatgctttgacatggagatttccttccttctctctcatgggaaagtaccttgagaaagagctgacagatgaggagatgccattagaaaatatgactgaggcaaattcttcccctataaggaggaaaaggaattcgaagcctcttaagaaaattccaccatgtttcctgagacagaggagtgagaagagcagactatgacatacctccagtgggacatagcgagaaattccagttcaaaccagacagcaatcttcttcctaatggatgggcagaggaaatacagcttagatagtaaaaatcaagggcctgtgatggctcagggcaatcctggcaataaggaaaaagaaactcatggcatctcaggggaagtagcacccacacttgctgtgaggagacacaagggcagaagtggtgtcagggtgagcacaggtgaaatatggggtccagagatgatagtagggatggtgacagggtagtgacagctggagactctggctcttaaagttgtcccattgcacagcctggaagggacaggtaggaattccatcaccaattccaccttggtcccagccaccatcatctcttacctggatgactacagcagcctcctaattggtctccctgcttcccctttgtcccttcagtgttgattcaacataacttccagagagaaccttttttaaaaaatgttttatttagaaataattttagactcacaagaaatggcaaaaacaatacagagaaattctgtgtatccttctcccaggtctcaccaatgagagcaagttacataaccatagtacatcacacagctggcattggtacaatactttatctaaatgagagaccttttcaggagtctaccactcttttcatttactcacttatatatatatatacacatatatacacatttttgctatgaaatgttatcacacatatggatttgtgcaatcattattacaatcaggatacaaaactggaatggatgtggtagctcacacgtgcaatccctgcattttgggaggccaaggcaggaggactgcttgagcctacaactttgaggcaagcctaggcaacatgagaccccatctctacaaaaatttcattttattttaaataagccaggtatggtggtgcacacctgtggtctgagctacttgggaggctgagtcgggaggattgctggagcctaggaggtcaaggctacagtgagccaaatagcaccaatgcagtccagcctaggtgatagagcaagacgctgcctcataaacaaaacaaaacaaagacaaaaacaaaaaacaaaatggatgcagaactgttccatcaccacaaagaaacatcctatgccactcatttacaggtatacccttccccaaccctaaaccccaacaaccactgatctgttctccatcactatgatttttccattttgaacatgttatataagtggaaccatacagtataaaaccttttggaattggctttttttttcagttagcataatgtccttgagatccatgcaagctgttaaatgtatttgatatctctttatttttattattttttgagaaagagtctgctctgttgcccaggctgagtacagtggtgcgatcatgtttcacacagcctcccaggctcaagagatcctcccacctcagcctcctaagtagctggaactacaggtatacaccaccacacccgactaattttttttcctgctagagatggggtctcaccatgttgcccaagctaatctagaactcctatgctcaagcaatcctcctgccttggcctcccaaagtgctgggaatacaggtgtgagccactgcacaaggctgtttttattcttgagtagttttccatcatactgatataccaaagtttgtttttccatttacccattgagcactgaaagacatttggggttatttctgatttgggactattacaaataaagcttttatgaacatgaatacataagattttgtgcaaacatacattcttatttctctaggataaatacccagcaatgtgattgcagagtcaaagggttaatgtacgttaaacctcattggaaattgccaaatattttcaagatcattttaaatcaaaggtcatgttaaatcacctcttattcaaaaccctccaatggtttcagcatcttactcaaaccaaaagccaaagtctgtcattcagtcatcccaaagaccctatacaacccagcccctgatcccgctctagcttcatctctattcctcttctccctgatcatccagctccagccacactggtctcctttctactcctctcaccagccaggccactcccaactcagggcctgtgtacttgctgctccttctgcctggaatgctcatccctcaaaagtccacatgccttgcttcctcatccataaggtccagcctttcaactaaagtacctccctttcctgttttattttatccagaaaggacacatttaaaagtctttctccaatatcttctgtaagtacccattggggttcatggaggaaagccctagagagtacacgcactcccacaattctgtctctcctcaggttcttcagtttcctatcagttcactctcagcctccatcaatttacccaacagcgtctaccccctaccaagccagcatgtgtgtcttgtctctttctggaggccccattctcttcttagattctgagtcagttggttgtcctacaaccaaggtcctctatgagttccagacaattcataacttatagtttgatacactttttaatttttgcattataagaatagaaacaatgctccttctagctgcctatgccccaggaggaaagccagggtcttctgtatcccagtgtgtgctgaatgatgttctatgatcactggccctgacacatttccctgactttgccttccaaggtcctcatatgcccaggactgccaaggctcctgagctaatcatgaaaatggcaagaattagatcagaagacacaaactgcctcccatacacagacttaggaattaaattgtgctgtcaatcagaccctgcaagggacaagcagtagaggtccctcaggccttccaatggcaacttttccagttactgtgttgaaacatttttttccataatctttgtggacatgctgaccaataactttgactccttgtaggactagaaccctagccaaagacccatctaagcccctctctcagggtcttgctgccatcctccggtcagtggttgccatgctgctgtgaagaagcaggtgcctctgctgtggattagctatgcctgactttgcactctgtgctccacctggaacccccaatgtgccagattgtcagcctctggtaccatgtgccagattgtcagcctctgttaccatgaactgccttcaccacacccattcttgggataggtctgtggattgttcagatgccctttgatatggtttggctgtgtccccacccaaatctcatcttgaattgtagctcctataatccccacatgtcatgggaaggacctggtgggaggtaattgaatcaagggggtgggtttttcccatgctgttctcatgatagtgaataagtctcacaatatctgatggtttcataaagggcagttcccctacacacgttctcttgcctgctgccatgtaagatatgcctttgctcctcctttgccttccaccatgattgtgaggcctcccagccacgtgaaactgtcagtccactaaatctctttttctttataaattacccagcctcaggtatctcttgtagcagtgtgagaacagactaatgcacccttatagtagtcaactgtcacagcctcacttggtctggatccattctctccccttgtttctacctgagccctgtactgaggtatgggtaatgttctctactgggcaccattaacaagcagaaatgagatttgattagcaaccactgccttattcaagaatttctccccaaaggtaaagctggccgcagacccaccactacctcctgcagttaatgtaaccagtggtactggtttactttcatattaatgttcatttaccagaagatgaggaagttatatacactccatagtacactgtgtttcttatcatatttttaaaagcaacactaatacatttttgttactagtttagcctaaataataaatgtgtttaaaactcaaaatgactatggccacttcttatatcagaggggaaagttaaaattcctgtcattgagaaaaaagtcactgccagttctgctatactggtaaagaatcaatggtcattttgtttagcaagatattaacaaatttttagacaaaggcaggcatgaagtcaaataaggagttgccagctagacaactgtgcataaaatgcgagaaaaactgtatttaaagtatagctagaactggagcaggatgaagctgcaagagactggagcttgctacaagggtgacctaagagaattctgtgatgggatgactggaggacatttagaaacagaaaattctaaattcagtttgaggttgtgttgtggtgatggaactgctaactgatccctgttgccccaaacattcaataaagtctgttatacctaaaaatgccttgtgtgtgtgcaatccacagggaagtctaggaggagaaggaagccaggtatgggtcactatggagcatagggaagcagatggcaagggagatcaacacttcaatgggaactgaaagtcaaagtcagagtgactgtgagaatattacctctgaggaatttgaaaaaaaaaaaaaaaactttggtgggcctgaatgccccattggatgtagaaaagagggtttttgtcagtgttttgtgaatccagtcaagaagggcttctaaggtgtcatctgtgatatgcttttgcatatgaatggctaccccttccagagatgtggttgtggtataagttaatgtcatggtgacataaagaaagatgtgaaggggttaaaatactgctgcaaagaacagctctggcagactgaagaataagtcaggaagctgtttttagaatcaagagagttctaagttaaccagccataataaattctgtattcgaagttaagtgtcacgaaacaagaattaagaagatagcttggcagttttctggttccaagatttcaaaaacattcccatgataaaggaacaaataattagaatgtgtcaaggcattttccagacactcttccgaagacctgttccgaaggcaacacgaagctgctctgagaggcagtgtcacacagtggttacacgtgcaggctcgggagccagtttgcctgagtccaagtgctagctcagctgtttgccagctgcgtgctcctgggtatgttgcttatatttgctgtgattccattttcttatctataaaatgtgaacaataataaacagttagaaattcacagtgttgtcgggaagatggcatgaatcaatgcatgggaagcacttagatgggcacccaccacccaggaggcactcggtatgtgtcaatgctcttttcatgaaagagctataagcgctcactgaaagtgccctaaagccctgccccaagagctaagaatcacactcccctacttagggagaaagcttaaggtcacagttttggagtcttccatggaggtgagaatcaagacagagcaactttcagagtttctgcctccttattagcctctgaaaatacagaaaactccactagtttaacaactgcacatgctataataccatttaggtcagaaaaatacaatgttcccttaattaagacccagaggttacagctgaggaaggcaatcagccgcttcagaacatatgcttcaaagaccaacctacaaatgcatgggaggcagtcatgatggtggcggatgagctaaacagacaagggttttctctaaatagagattttcacaaacagttgatgaaatggcagtacaccaggtaacagatccaattatggcaaaacaggggaaattaacgctatgcctcaggcataccgtgtttagaccagtgatttctttttgtgaattctaatatgtattttttactgtgattttgaaatacctttctaatgtttccttgttcaagatgtaagtgtgaatccaaacacatgcatacacaccagttatggctttgtaaaaccaagtaataataatccgccacaaattgctaggatccatttttcaataaaaaataaaagccaaatcctcgcaaaacaaagaaaaataatcagtactgacaagaatacattgcctaacctgtgtactgtaaaatctcaagcaacagtacagtagttaaaggggaaaataatgtttatttatcacctttatcacctaaatgcgtgtccaaatactatgttccacattccccaaaaaatctacaaagtggaggaatttttaagatccttttatttatgttagccgaggcaagaactgagattcaaaagcagttctgtctgagttcaaagcctgtgttgtgcccactacactaatatcccgagacacagagtccttagccttcctcaggaactggttatagcttatggcatttttttctttaatgatgctcactcctaagaaatgtttcctaatatttaatctaaatccctctcttctcttccagtttaaacaattccttttatttgtgtcctcgatggggagagagaacattggtcagtgtcctccttaataacagctctttaacagttattaaattgcttctactccaggctaaatgcatccaactcctttaaccttttgttaaagggccaattttctaacctattgataattgcatttgctcttctctggaccttttccaagctctggatgctgccctcaaaattcatatatatacactcctcttatcatgaagagcctatgccaagtaaagctaaaataatccttcccagttctttcataagagaaagagattcttaattttaataaaagctttattttgttaggatattcgttagcaatttacaatcccttatcgttacagatttctttttatgacactctttcctagtccagcttgtgcccaatgtagtgtgtttattagcaacaattacaataactaccttgaaattactctctaaaaacatgccaagtgctttgatgcctagagggatagcagcctgtgctgacagggattgagttgttgaacaggaaagtttatgtaaggcctcaacaccaaggatcctggcagtagcaagaagaaacagagcattatgacagagcatgcatgtgacagcatcagtatcttcttacagcaggggcatgtagcacagaaagggatcaggttgtcttgtttttctggtgttgtatccctagcgcttctctttgcatttctgcctgggtaactcactctaatttctcaatttatgtccatattgcttcttggatcactcttttaattcaccccagactgaacttgatctctatcttctttgacattagcagtcccatagaaagttgcaggaaggcaagtaagagtacccaggtccaataaaggcttaaagggagctctctcattcactagtcaatgaaacactcattcagtgaaatgctgctgtcaggacagaatgtacttcctgtagacatcattggaaagaaactgttcctgtcccatgtgaaaaaaaatttttttttttgagtcagggtcctgctctgtcacccaggcaggaatgcagtggcacgatcatagctcagtacattctcaaactcctgaactcaagtgatcccccacctcagcctcctgagtagctaggattacaaattcacgccaccatacctggctatttttttttaattttttatagagatgaggtcttgctatattgtccaggctggttgaaaactcctggcctaatgcaatcctcccatcttggcctcccaaagcactgggattacaagcatgagccactgcatccaacccatgtgagattctaacctcatacaactcatcttttgctatggggtagatactagacttcaattgctcatgcatgcagaactactctgtcctatacttctctatcccacaactactgcaatgagtgctgctgtgaaatgtctctgggcctctttgaaaatctccatattcacaggagaacaaagaagggaacagcagaaatagctgtgaatacattctccattcttgggcaggaccagtctatatatgtgattttcaggcaggcacttcctgcctgaaaatgtcctcttgaatgctagcagaaatagctgtgaatacattctccattcttgggcaggatagcatatgtgatttttaggcaggcacttcctgcctgaaaatgtcctcttgaatgttagaaataagtggaaaaggaggaaattagagttgggagaagtaaagagattggtgaagcaggaatagatgtttttgtattacagtcatggaaaaggtaaagaaaatagtatcaggtgtgattaggcttgtctgtatataatagaaactcccaatatgtggcttaaacaagacaggtttgtttcctcttcagataaatgaagtagagatgtaagcatttgttatgaatgtctgtacccctccaaaatgcaaaagttgaaatcctaacccccacccttataaaagagaccccagagagctcactctctccttctactatgttaggacagagggcaaacactgccatcacatctatgaagcaggaaacagccctcactggacaccaaatctgccagcctcttgatcttggacttcctagcctccggaactgtgaaaagtaagtatcttttgcttaagccacccagtcttagcctgaactgactaaaacagacacatacactgctatagcaggtccaaagtcatcaggaactctagagcctatctttctacatagtttctatctgcaaggcctaaggtggctatagtgcttcagatattacatttcaggcaaaaagaggaggaagaagggaagggccaaaaagatttccctctcaactgagtcagcctgcttcacatagccttcccgaaagcacacccaaggacttctacctaatctcattgaccacccatgggaagctaggaaataagagtgtgtatctgggcacattgccaactggaaaaacatcaggtttctaggagtaaatggagaatggatattgggtaggcaactagcagtttctaagctaaaagctaagacaaaatactttcggtcttggctcttaaatcctgcatgttttttgaaagtaggaagggaatgcactgctatttccctaatttgacatttctcccatgggagtagagatacatgaatgaaaatgaaccagaatatttaaatcagctgcatggaaatttatcactcacatcttccaaattatttttaagtttaaaatgaaaggaaatcttgattacatgggttaaaagaacaactttattatatcagagggagctattcaaactgaaatgtacagctttgttttgaaaacaaaaaccatccattagagggggagttagttcatcaaaagaaagaatgaaaccagtaaacatctgcaatttcacatgatgaggggaacaaaatataaagctcagttattttaagcaatagacaaaagaaaaagtgaaagcagaagtaggcctaagacttgtcactcttgctgccacagggcataccactcaatcactccgtgtggacacatctggtggaaagggaggccctccatatttcactcagttctgcttatgcttcttgagaccctccaaatagaaaaatcacattatatattttgacaagaggctttcttgtttgcaaaggtatcaaatagtcttacaagggaagatggcacacattaagagatcatttttatgatgaagaataaaagcccttcaattcaaggctatgtcaggaaagctgggatgtacagtagccttaataaacttggattgacctttacaatcaggaactataagactctacctgagacttactgttctgcaaatgacacctaaaccacaggtccaagtctcatatccggtctgagggaaacctggcatcaggcaagagacacggagcaacaggaagggcaaagacctgctcttatttccttgttaccttctcactgccataatgaactaaagttccattgagtgttccacaattgtattgtaatgtttgggaagcaacggcatacataaagtcttctcaaaattataatgcattcagcaacaaaaaactttaagtatttcttgctgagttgatccttcagatcatgtgcatatgggcagaaaacatgagctttgcagtcagaaatacttggtggagaattaagacccatgattcactgggcaagggtaacactgggaaagcaattaatatttttcacatgcaaaactggggaactagttctttacagtggtgttgcaatgattcaatgagatgatacacagcaagcacctggcacttagcagatattcaacaagtgttagaatctctccctctctcccacctccccagacttctttcccactctcaacaattcactgttttggatttacattcacatatttagcaaaatttgatcatattaatatattatgaggttaaatgagaatgccaatcatatcaccaacatggattaaaaacttttgttcctttacaatgtgacattagtcatagacctccaagaaatagctggcctgagggatggtttcaggcaaagattctgggatggtgcagaagtatgtgaacaccaccagcttcaaatctcagatcagctgagcagtctcccagatgtcattcagcagtcttcctcctatactcagtcctttgctccaggactagaagacaactcgtgaaaactgccagtttcattcatcagctcaaagttgaggttaccaagtaggccacttcggaatattgcaaaagagatacagggagagatgaaagtgaactggaatttttcataccaatgacttaatatgggaaatagtgacaatcttctgggaaaattcacttagacatcatttaatatatttggatatagacacagaaatactgatgttgttgttttaagagcttgtatttcgaatgaaatataaagacccttaaatgcatattgttgttagcgcttttgaattattgaacagtaaagatacatgttctgcgtgaaatgttcatttcttcaatgcttggaagtgaggtactagggaaagcttcacatatacgtgacaaattagttgctaaattctgtttttcagaccatggagttctgatttgtttatttttaaatacattatttatacaaacacagttttttttagagtaaatgcaagagaagggtatagaattaaataactagtcaaattctgaaataagacaaaactacccattaaaatactttcttgttaattcactttaatgactgggaaatccttgacttattactatgctatgtaaatcaacatgcaaaaaagcattaaaaaaatttagagcactacaccgcaatccatagttatttattttgacaattctagttgttttaattattcattatagtactttatggcagagtgtaaacgtgctgcagtattttttttttttttgtaagtttaaaagtctgtgtatggcaatacttcaagagcgcttttttcctcccattaaatgttttgtataatcaggaaagagactgccttttaagtaaactttcaaggttattaaccaacacagtagaataaattatgtcctactcctcacctacttttacaatttgaagattttgaagaaagataaattattttttaaagaatatctccaaaaaaaatattgtgagctttgcctaatgaaattcttgaggttaagtttttagtatttcaaggcttctgtttgaaggggaggtaggaaagaaaaccacagatatcaagtaatcaaagaaagattttaggaaacactacattttctctttaaagtctatttgttgaatgtaaaacaacatagacacagaagggcttaaatctatagatattgttctttcccaaaatgatatgaagggaaagaatattaacaatagacaataaagatttagagatcaaggataattagatatcaccaaaggcatctgcacttgccacacttaagaatagggtttatggactgctgccttctgatggaggatgaggaagagagatggaagttaaactcttctctacttttactcagccaagcaaaggttttcaacagaaagtccctagacacagcagtgcagtgtttctgcacctgttgacactttaggatactgggtatttcttcagcaagaaggcactgactgtttaagagagtaattttatgtgtgctataagaaagcaactttatgtctgccttttaggaagtatggtatttaatagcaggttcataccctttatataacaaatactgtaatgtgccactagaaatgaacagcaggaaggggaaacatttttctccctgctatataggctagagggcactgtagtataatcttagtagagacgttttcaacctttctataacccagacttttgcacatcagttattgaacaaatatttcaaacccctgcatggtggtgctgccctgcccactggccaagaactgcatggaaaagtggaagtaatggaagtattaattagtcaaaatgataagaagcaaggatcacagatggaaaatcaattgatctgagagttggctgatggtgttttcaattatgaatttaaaaaatgaaggttagaaatgtgtatgaaattctgggaatttatattctgagactgtgtctaaaagacatatctaattggggagttcatcatatattagttatttgcttatgaaaccccattcctttaaataggaagcttgttaaaatgttcagattgggctgggagcagtggctcacgcctgcaatcccagcattttgggaggccaaggtaggcggatcaagaggtcaagagatcaagaccatcctggccaacgtggtgaaacctcatcttctattaaaaatacaaaaattagctggtcatggtggcaggtgcctgtagccccagctactcggggggctgaggcaggagaatcgcttgaacccaggaggcagaggttgcagtgagccaagattgcgccactgcactccagcctggtgacagaatgagactccgtctcaaaaaaaaaaacaaaaaaaagtaagctttgtttttgtttgtctttttattggtaaagcaaaagagagtttaaaagattggctacttctatggtgctgcggtgtcctcaacaaaggagatttcaccatcccaagtccttagatacaagaaatattgctgagtctctatgcatgttgactctgtaaaagcatttgtgatacctcacaaagtagatagcatttgggtattcagtaaacattttcaaaattgtaatatataaacaaatggaggctgtttgtgtttcctttttactttaaattctagttcaaattgccccatccagttacccattactataagttgaaggaacatgaatgtggcaagttgcctggttcttgttttataaaaatgttcattgtaggaaatctctgctccaagctcctcactttccatatgtggatgtttgtgtttgtgaggtgtgagtgcctagtgcctagatagagatgatagatgccattggaattacataggtcagtagttgggcagggcagaaagccccaggggaggatactgagaaacagacaagagggacttttctttgctaagataatcttaactctgttgttaggaatacatggtttatgagagcaaatgacaattcaggtatgattgaaatgaaatattctgtgttttcaataggaaataattgcaaatcaaaggttttatgagcaaggggaaaataactacacatcgacccaaaatttatataaaggattcaacctttaaaaaacctttcttgaattttcagctgattagaaggtcttattatagctcatattaattacatgtgttattatatagtcattttaaagtgacagactaagtttagaatgctcttggcaatgctcagtgaggattttacaagagtttctcaggtttttaaatgattttttcaactttcgcaagttaccttaataaaagccatagtgttttcgatttctactacaatgtaataggataaatatatccttttatatctttaagacattttaaaggaacattttctgcacaaaatttgagaagagatgctattagtaaaaaggtggtcagttctcgatgtgtaaaacaaaaaaaaggatgtattaaatcataagaaaaaaaggatgctcaattgaaaatctgactggactatctaggcacgcaaatattaataaaaattttaatttcaaaggcaaaacttgtatcatttaaaatcaaggtagggctggtgcaatggctcatacctgtaatcccagcactttgggaggctgaggtgggaggatcacatgaggctaggcttgaggccaggaattcaagaccagcctgggcaacatagcaagacctcatctctacaaaaacaaagaaacaaacaaaaaaattagctgggcatggtggacacacttgtagtcccagctacttgggaggctgaggtgggagaatcacctgagcccaggaagtcgaagctgaagagttgtgagtgcaccaccgaactcagcctgggcaaccaagtgagaccctgtctcaaaaaaaaataaaataaggtagaaaagagcccagatttcccactttctcttattattttatatatcttccttattactctcagtactgatgaaagcaagttaccaatacataggatgtatgtagtacagcatcattgccacagaaaggcaggatactggcctctcaagcatatgcactctgggactaggtcatccctaaaggagccaagctgttgctaggtaagaccagaacgggaaggcacaaaacagactgcaaataaccaaaatgggagcaagcaagggtaaattactttggtgtttattgggcacctactagactggacaccatcaggggctagaaatctacattcttaagatatactttgtctatagaaagctcctagttggcttttctttttaactttttattttaaagtaattttaaaccttgagaaaaaaattgaaaattgtagaaaaggttcccatagacctttcccccagcttgccttaatgtcaatatctcacataaccttcataccaatgaccacaactaaggaattgaccttggtacaatactattaactaaactacaaactttgtctcaccagtttttctactatggtccttctgttccaggattcactccaggatcccacattgcactttgtcatcatgtctctttaatcgcctccattctgggacagttcctcagtcttttcttgtctttcaaaaccttgtcattttttgttagttgacttttaaacaatcatgatggaatgtgtaagttctatgagagaagtacatttttgctagtggggaggagaactttaaagaaagatgacatttgaactgggtcggggaaaataaagtaagattttgccaatttagtacttctatctcatctgttcaactcaacattacttatagtaatagaacattaggcattggaaatatagcattgaacaagacataaatggcctctgctcatatgtattttatgaatattaaacaagccacaacaggtacattaagcataacaaggaagagataagaaggactgggttacattcagcaaatgaatctcaccttagctaaagggccaggaaaggttcccaggaggaagcagaggcaagttgagatctgtgtggtgaccaggggttagtgtcaggtaaaaggaggagcaagagtgttccaggaagtggggggtcagcattccaaagacatggggacagcagcacttgtcatattccagtaatttcaaatgctgtaccaatgagatgacgatagaagggggtagtgtgaagaaagactacatgaggttggaaatatgatgagaaacttcaaataacaacaaagaaaggggagaaaacaggtagaaaagtaaaacagaaagagattcctacatcaattgcacaacaacaagttccattcatttttctgaattatttgaggggagggtggctggaacaaggagaaagggtcatgccaacctaagaagaagacatgcaaagtgacaagaacagtgttggattgcccttcaagatgacagagattagggcattagcaaaattgggttacccaaagtgaaaaaaaataataaaggtattatttttccaaagaagtatcagcatcatggaaattttaagaactttgttaaacttccttaaacttattttaatgactccatattgtttttattttgaattacatcaaatggaagatatgatttccatttttatggcttctaaatgtcctagtcttggccgaaaatacagatgctaatgacattccatctcaaaaccaacaagatgagatgaataagagagtgcagaacacagcttttttggcaggagggcagaagaccaggcagagtgtgggtggcaggctgaaagtcaatgacaatctgatgcaggcctagccagagaacagcaaaaagtccaggaaagtctctgtcacagaaatcagggaaggagaggatttcaagaaggaggcacccctttctacagagaggtaaaaaaggataagtgctgaaaatgattcatgtaagatctggcccttaacaggttagctgtcatgggtgacctttgttagaacggtttcagaatggtaatggggtagacactgtattaaaataaattgaggaacaaatatgatctgaagaaacagtgttgcatattaaacaccctcttgcacagagtttgtttatgaggagtgagattggagtgcatggtatataggacatagaaaatattttaatggaagatgttatattcctagaccagagggaaaaaatgatatggaactttttgctggaagaggactgtatatcttcagggatactgttttgatgatggtagctgcaataatttttagccataaaaatgtcttcattgcagatctaagagtagtggaagcaagatgtctgcctggagaatgactaccttgaacttctgatctgaaaacaacccttggatttaagaggagccaaatgaagcctgcattgccatcaagactgcctcagacatagtaactctatctatccctcaatggaggagcttagacttcacaatgcacccagcaccaaacacctctttcttccttttcagcacattcctcaatatttttgttattatgctctctttacatttgtgataataccatttattacttattttaaattttttcttgctaattcactgtttttaatctttttgaaaaatctccttccttctctctatccttgttatcattcatgtctttgttttgctatttttccacgttagtacattatgatgcattagttcctagtgacatgagctcctagtactttcctcacctctatctcaaatggcctctttcacaccaatcatcatatccttccaatgttctctatgaataatgagagaaggtcatatgccaaagactgagcaatgcaggtggagcagagagcttggggtgaatgctaaattcagaatggctcaaacaaataggttatttacctgttgaagactgataagggttttgaaaaatcattgcatatgcaaaactagtttcaatgtaaatcctgtatatagaacatttcaacaaagatgttttcattatcagctcacgtggtcagtttaaggcttcttccctgaccttgctgccttcacactctactcttttactcctttcctacttatagccaattagaatttactaagtgcctaaagaatgtcctcattgagttacataagtaattatatgaaagctgctgtaatggaggtagagacagtgtgtgtgagaacaaggtttagatgattttcttctaaaacatcttttggctccttttctttctctttagcccctcccctaccttctctttgtctttaccctagctatttctcttctaatatgtctaaaatatcatctttagttaactggctgaacacaataaaatagttccaagttactgccataataatgtcaaatctactgaaaactggatcaaaggcctttcatgctattttggacagcatccaaactatctcattcccacaacttaagttttttttatctcatctaagcagattataatcaatcacaatactcttctgtctctggtcagtgcatttaatcaaagtcttcttttaatggactttcaaggttgaagagcactatcactaatgactatacaggtagtacatgcaatttcagacacagaagcacatgaaatatgaatttcccttgtttggaagcaagacttaggctcaggacacatctcttcctagcattcattattctccttccttctgtctttctggccagtttaatgactacttcatcactagcctttctccccagttgtcattctctctctgcctaagtacaaaagatgaagcagggtggagggcctatatctatcttcagagatgagccttccctttactttcttctcctgcattctataaaatgtaattccacctttggggagtgaccatgggcttgcaaaactcctggttcacccgtaatcagggaccgaagccaggacactgaagccatggtatgaccaccaaatctgtattgaaaccaaaaggctgcagcagaaatctttaagcaagagctgcagaatgtgtcagtcatacaacctttccagcttaagaacttatgaagttgggtctcggtgtgaacataaccacaggcccttcctatttagcacaccttctcttaacctcaaaaacattttgaggacaaggaaaagaaatagtgagtgtgaaaatgaaacccaggaaacttgaaatgaagagactgagaatcaaagaattagaaatcaaaacgcaaatcaaaaacgttttctaaacttgactttgtagaccagtgattctaaaactatgtccctagaagttcttcaaaggtgcttcaaggactcagagggtacgtccctaggccatagaattccacttaaccagaacagctccatctttatcacttttacatactggatctccaggtcagacttcaatttgaaggacaggttctacaacatgaagaaaacatttttcaaccattatttcaactgcagccgttcataccttcatctattcagtaaacatttattgagcatctactacgtgccaagcattgtgctaatggatggggatacaaaaataagtaatatatggttgttaccctcaaggggctctccctggagatgggtagagaagcaaattatgcaaaactcagagcatggtgatttatcaggtgctacaacagtgggagaaactggagctttgagatcccataaaacaggtgctttaatatctggaaattggctttgaagctctacttaaatatatccactggggggaaattctacaaaatggttgattatgcttttaacacttataactcttagaaaaaaatttttaaaggcggaaatctatgttctgaaggcttcaacccattggctctagttttattgcaaagtatacacagagtcagtccactaaccctttccacaagattgccttttaagattggagttcagtcatcattctcttctcctggcattctactctctaggcataccctttgtttataattattatatcatggctccatgtaactaagaaaaaaagggagtatattttgggagagagaaggtttgaagaaatgactcctactatgtgagagctttatttgggataattgtaagagcagttcctggtgctctcctagaatcaagaaaatagtatgtagatgaaattggatataataaaatataaccacagatcattagggctcatttttcttcctttcttatcatgcaaaattaatgaaaatatagagggtgtccaaaaacatacaagtatattgaaatattttactgatgttactttgttggcatgttcaatgtgtcatcccttattaacaatacttagttcaatgcactgagcaacactggagtgaacacagtgtgcaaccagctgccatcaattcctggcaccagcatctgagatatgttgcctacaataactatatctctggttttcgctgaataaacctgcatcttcagcttactctagaaaaagtaattacatcaatctacatttttaaaataaaataatattacctacatctctggatttcatagccagcatctatgtttcattacattttagttttactttgtaatgattacaacttttaaaaaatgatcagtttaaataatattccaaaatgttggcatacttaattttataaaacataggagtatttcttttttaatcataatttctatgtatatattacaaagctattactggattaggaagctctgaaggccagtgtgaaatctaacacacatataatgttatatctatgaaaaaatgtatccattcaaatggtttcaagattaattttctggacacagactttaaatattaagtatttcactttcactacaaaatttaagtaccaaaggaattgaagaaatacagaagcctgttttctaaaaaaaatgtatagatattactatgatgtttgatgtgtattaaatgtgactttgatcttcctggcagcctaggcaaaaagaaaaaacatgaaaaaatattcaattatatttgattcatatctgataggataaaatactttttaagggaaaaacaaatattttattactatatttcaaacagactttatcaaggagtattaataaggggaatttaaataaggcacatttagtaatatgtcttcaacaaaaatatgcaatagaagactgaaaaaataatcctaacaatgttatgtattacatatatcttcaataaaatttaagaaaataacattaatgtcatctagtgagggtatttttgtgggggctacaatcgaagaagtcaaggaatatctctctctcatgaaccatgatcattaatttatgagcggaacctaaattaatagaaaaggcatgactattattttctttctctactcaggtgtggctgttacaggatatagatggaagttacctcaagtttaaactctaatgaaaaaacccataatgcaggtaccacgtgttcatgcctgaaagaacttcaaataccaaacatgaatgtgcaaaattaacactccattatagaagctgaaaaactgcctacaatcttcacctggataagaggttgccaaacaagtcggccgccacagcatctagggcaaaaattggcctcaaaaagcagctttggatctgctttagtacctgaaacaagtgcttgaaactccaaaataccataacaaataatactctttatccatgtatttctttactccaaaacttctcaaagcttttaattagctcacaagcaatgtggacctcccaaagtaggcacagcatgtgcagtaaacttatctaatcacaatgtccccatttattggagcattttgcaagattaatgtcttatggaatacagtttagaaaatatcaccagagatgacacaagcctgaatatcttagcaacaggtatcacaacctcagaaaaaaacaaaacaacaacaaaaaaaaccctcagtaatgttccagtaaaacatctggttttcagcagcaataatgcatcaaagatcttccaactgaaattaaccttaaaacattctcccatacacacaactaaatgaactaggcttcaggaaggcattgcttatcattgttggagaattattttgttattttgttaaaataacaacagctttggcatactttatattaagctgctctttaaaataataatgtgacaacataatcagctgcttcctggaggtggaaatagaaattcaatgtcttcagtctaaagaggaatgtttttctattcaattatatcaggaggtcaatcaagtcataaatctgaagcttctaacttaagataaatgaaaatggaatgacattaaaatattatactgttcatatcatttaatgttaaaaatagtctgttagtagataattccttttcattcctgtcatcaaagaagtatttaaatactgattttgaagtatcatcactagcctggacttgataatgataatacccaataattactgcaccatgtgtaatagtatactcttgttaaagtcattaaattcttataacaatcctatgagatcagaattacgctatccctgtttaaccaatgaggaatgctctacagactacagaaggacactatgagaaataaggagacattttctttatctgtaaattttaaccacttttctcacgtgcaaatagcaaattctgggaaggtaattgtttttaatttgacctaagatatctaactcaaaatggggggtaggcacataatcaataatgccagccccaggattaagagaaattcttctaggtttgctacctattttgctgttgttaacaatataggtaaagtttataaatactcttcatttgggcatttacatcttttattcattcaggttgtctagaaaaaaacatgtaatggatatgaattgtgttattgcaaattttacttgcatcatcttttctgcttcattttgctaatcataactgtgatgtagatattaccataattaaaaatggccaaaacattagcacatcagtaatgactacagtggattagccattcctagtatgttagtttcaattctacctcattctctcaggttttaagaaagcatatcagaaagaaataagcattatgatagggatacatttgagtctactttaaactacataaaaaaggaaaaactggctcttagccttccctgtttggcgtttctctggtgaggggtttggtggttcagagtacataaagttttaaagatcaagaatccgaaacctgaaaatcaaagaatctgcatgtaccctggcaggagaaaaacaaatatcaagatactgtagatgagtctaatcagggagctgaattaaatcagactaagccaggcatggtggtgcattcctatagtcccagctacctcaggaggctgaagcaagaggatcacttgaatccaggagtttgagtccagcatgggcaacacagagtgaccccgcctcccctcgcaaaaaagactaaaccccagaaagcaacaagcttctctattttatggacataaatcatgtctctggatgtcccagttttgtgtctcccaatttacctgatcttgagggaattcatttcctaaaatctcagtcttctgcagacaaataaagtccacatattggacagaaagtccaaaagaaaacttgggagactggaatcttgcttttgagatgttgcttctgacatgttccaagtaaagagttttaactctaaaaggaataaatctcccagagaactgactaagtgaggaaaatgttgtcattttctttctagaaaatgccaaactgtttggtaaatgcctattaactggagtaacaccatgagagttagcctgatttaattgcctctgcatcttggggtggtagtggaaaagactgtaggcttcccagacaaagccatctggagatgagggagggagctgtctagacaaagagccagctagctttagaaaagaagagtgtatggtgacaaaggcgagtgagacggaaacagggtggaatcacacagagtgtgttctcagcaggcatcagacgtgggtgggaatcaagcagagtgacggaatcgacactgctgtctgtcatcagccactgcaaattccagatttggcacagatctcctaactgtgtagcttttgcatgtgaggctatctgttgagaagaaagatattaaacagggtggggcctatgtcttgtatgctgggcaatgaacttgtgaggcctcaagcctgacttttcagaattgctttcaggattacttcctgctgctgcctaaacaaatataatgagtgacagccagacactgagttagacattggggatgagacgaggaagaaaatatagttctcccttcaggttgctgagcacctattaacactcagccaaaattggaagcaaagggagaggaagtgcattcagaatattcttctcacaggaggtctctgtgagaaactcatcatgccagaaggcacctggctggtccttgagaagggctgaagcatgcttttgttgggggcaagggcaggtgggctagtggcactctgggcatgtgcatgcacgcatgtgtgggcacacacagaatggtgcatattgtggagcctatgggtcctaagtatgcccacctctaccctaaatataaaatgattgtatcagaaagcctaataaaaaggaaaatggcaagtatgtttttaaaaaaagttcaaaattagtggacaaaaagtcccacatgctattttaggttggggcccctgcaaataacacggaggtatctgtacatcaactccctgaggctggagtacagcaggaaagccaagccctaaggggctgggatgctcctatctggagaatttgagagaagaacctggtgttcatgctcccttccgcccacacacagtttatgcctaatcaggtttaggcatgtagaattcagctctcctgggaagtcctgagtttgtacagacaacagtctcagcacttcgccttccagcaacccctttcagaagccaccagtgtgctgtaaagtgcctttcatgtttaaaaaaagaaaacccaaataaaacctccaaataaaaaatattagaagtattatttttttaaatgcaaaatgtatctaccattacttcaaaatctcatattccaacaggtttcttaggggggttaaaaaaacgattattcaaatattttttcttctccactttttgcaaaaatattaaaggaggcacaataagaaaaaaacagccaagaaagtccaggaactgaagcctctaataggaaaaaaaaatcttaatacaaaacaaatttcttgtattatactcttttgcctaggattgaaaggcatttaccctacctagaggcctgatattctaaaacaaaatcacttgtatttccattgctttgttaaaattaactgtgttcaatataagataaacatcatatagcagtaggaatacatctttataaaataaataagattagacatttttgtttgtctggttaagctagaaaatatttgtttccttacaaatgttccaaattttattatctattttctggtgatctccaacacatttctcagatttactaaatttaatgtaaagagggttttctccgtctaccataatcttaaaattgcatcccatgtatttaaagagtattttaagttcttcactgcatgttgtagctatgcttgtttttaacctttctatacttttatcagcatagccctaatttaaaatacattcacatgctgccactctaatcaataacaaaaacaacaaaactcagtaaccaataatctctacacttgcctaatacatttatttcaaatacagtccatcttacatagcaacaaagagttgttctctacacattgtgagcacacttccctcaatccaggaatgaactgctgattgccagagatagagagaaaaagccttatcaaagagcatctattcttaattgtttatgggaaaactatgccacaatgtgtataaagaataaattagagtttaaaactgtgtatttttcatattataatttgtgtatgacattaattgataaacacaaggtaaagaaataatttccttttatcacatgccaagtgtagtgcttcattttcattattatttatccaacacctaaaatattgcagaggggaaatttactgcattaatttcaatcactagacatttaaagaatgttctgagacactttaaaaacattattttaatttcctctgttttctcagcatcattctgtttaaatcagatattctagagaacattaaactggacaaattaagtcattttatataatgttccctctagtgttcataattttcaaaatgattacactccgccatctatctctttatatctctgaaccaaaactactgagtcctagtgtatcagagttttccaaagcaagagaaccaataagagatgtataaacacacacacacacacacacacacacacggagagagagagagagagagacttataagaaattggctgacacataagaattggccctcaactgagtggatgaagcccaccacattagttatggagaggctatgcagtcccaagatctgcaaggtaagttggtgagctgcagacttagaggagccaatgattcattacagtttgagtccaaaagcctgagatccaggagaaccaatggtatagttcaagtttaaaggcctgcaggcttaagacccaagaggagccaatggagtccaaaggtagaaaaaaaaaggtgatgttctagtttgaaggcagttaggcaagaggtattcttttatttcagaagagtcaacctttttattctactcaggccctcaactgattggatgaagcccaccacattagggagggccatcttattttctcagtcagccaattcaaatgttaacttcatccaaaacaccctcatgagaacactagaataatgtgtgaccagatatctcagcaccctgttggccaggcaggctgacatataaaacaaatgatcaccccaaccaatgatattcccaaatgtactcccttttgttctgtacttgctcctaagtctcccaaattccaaagatttaggacattaaaatattttcaaacaacctgtattcaaaaaaaccatatcaacaggaagttttcttctccagaagaaaaattatccttctttctcacatttacaagagctccctgttatttatgttagctgcccccatgaaagagtaatatcatcaaaataaactaaaagaaaacattaagcctaagttcaaataccaatcttcatttggcaactttctccaaaactccaagaatatcattaattctacaacattaaaaacattttatgaaaatataaaatgaaaactaagggtacatgaaaaaattatattttcatttaagctttctttatgccttgaaataaccttaaaatgaataagaaaaaattaatgcacaagtactgaacattcatcatgaatggttcagaaatgagtagggccagaggtcatttgagcttcagtcccacaaagggctgtcattttataacaccatgactttctgcagtttcagaaaagcagttttgttaggttcccccaggctgtaacaggtatgaaagaatggatttaccatagtccaataagaaggaaatctatgtaaatcccaaattatcaattttttaagtggaagacagtttttgacccaagaactaggaacacatctgcatgggacctgtccttctttagggttgggaaagagggagggtgttcacctgaaagcagagttagcaactggcagtttgcttggtgagaacagaacagagctaagattattatactccttagggaatctgaacaaggtaccccaaggaactgcccttctctactttggggatctttcatgtaaagagcaaggtggattcattaataatcaaaacatcttccctctgagcagtgctggggaaaaattgcaaattctttctctgcaactccatttccttttctagactacacggggactggtttgcattcatcattacatcattctcccttatttttggcttacataaatagactgttgtctgcttcctaatgacataaagggaggcacctcaatgacaccaatgaaatgaagcaagaatttggtttggggcttgacttttttcccccagataattacctcaattatccattccaatgggagggataaggaagtgaggtaagccagaaaaatgtgtcacaatgtataatattcacttgcaccttcactaaagtaggataaagcagacactcaaataaagagctggagatacgttaaggcaatattataaatttttgttaaatgccttacatacaaaatgcctgaagcaaatttttaccttggtaaagttaaaatatttatagatgtacttatctgtacattgaatatattatataatcaatttatataagaagggctaagaagggcagattaactagaaatatttaaaaagcaaataattgtcaataatataaacccaatagaatatttaaaggtataccaagaaaatgtatgtaaagaataggttgttaataaatttagttttggcaataagtcaatttgaataataaaacacatagagattatcaagaattagtatgagtcaagaaaaaaactacccaaaaaatgcctgactttgacgaacctgtattaaataataaaacctcagctgtccagcattgttgagcaaggttctcttccacctaattaacagagtatgccagtggctttctctgtacttcctcgtgcttttactctcccgcctacccagcttaatgtctcctggcccactggtataatcactcctttgcagtcacccctggtccttgccatcaacctgattaaaaaacaaccacctgattatatccacacacatgccttctatctccttcaagcagctggatgttgtgagagatacgatgacaagacacatgtcacattcatgtcccaaaagctcaaggagtagtaagcactgtccagtgactggagggaaaaggaccatcaaggaagttatagaaggaacccaagaactaaggggaccttttgatgtctgatgaagaataacctcttccccaccaggtcactgattactcttaatatttttatgtgtctaggaaagaaagttatgtaactcagacataaatcaggcccatagcccaaaaggctttccttaaaactttatcatcttgggggaatctctactcggcttaccagtgtccatgaggaccactgctgccctactaagacttgtacttattttgagtgtaatactctccacctccctaatacctcaatcccagtgccaaataatgggaatgcaatcatgtgatccgttcatctgcagtaaggcataaacggacttctctaatgatcttctggcaaattgtaacatgaaatgaggatgcatcctgtcattctctttcatgtgccatggcacaacccagcctctgaacataaccgtctaggaaatggtgacaggaaattaaagtcactactgggaaatgagaggtcctgatgttaccattagaggcaggtgatacgtgaaccattgttaccagtcatgagacagcacttctcacctagatggacataatagatgacttcagaagcccttcagctcagagaactgtttacaacagcaaagaaaatgctatgatagcctccgacctaatatgttgtcctggcagacacaaaatagcaaagaaaactattttccataaacccaacatgtgtcaactgcctaaagccccaggcaagattccacacaaaatacacaggaaagggactgctcctggctcctgacatgtcaatacataagatcagtacacaagaacaaaagccttatctggatcattgaaaggtatctgggctacctcctagccagactcttgagcaatttcttggccttgttctttacttctattaaaatatttcccaggtgaatccaccttcccatttctgggccccatgcatggatttctcctagtactgcaggctcctgcttttgaactcagcatagtagggatggggcacccacaggtggcctgacatcactgactgcacccactcactcatttgtacactgggggtagaacattatactaagttaaacatgaactagcaaagagctaggactgaacacacaaatcaggaagaattgttccatctcaacctgcttaaaaccatccagagaaactggaatctccaataggaagcatgtaaatgattgaagaatcagttctatagatctaaaggcattatttttccctccactctgaatgttcctcttttacatgactttatgaattcaggccatctttaacttcttctaatctttaacttctcctaattgtcactaaaaagtagctacagaggctactgctcattttcccacctgcctgctatctgcaaggaaagaggattagaaaaaggggaatgttgcttccataaacagagacatgaaaaattattaatatgaaataaatcatgcttgtttcaaaagtgtttatttcaccttatctatttgtaaaggatgtagctggtttatatttcatttagaaaccaacggtttataagaagagccaacaactgtgaaattctctttgggaaagaatgaggaaaaccaattaataaatacacaaaacaatcagcagtaaacacttttttaatatatccagcttccctggctctagaacacatcagtaacccccaaagcaatttacatggtgcaaggcttgccctggggtgggagtgaggaggtagagaggaagcatcattgcccttcacccaccttctataaaaccaggactccgtgttctctgtcatcttaaagagaaatcagtggcagctatttacattcttagcttgtaagaaagtttcacaatgtacccatacattgtcaaattttaaactaaggtttccaaatgttggatgtacaacagatttctgagtaggaaagtgttgcagactgcaagtatttatgaaatatccagtctttttcttaaaaagcaggtccttatacagttacaggcagcaatgtgcttgagttaagaaaataaaaaccaaacccataattcctgaattcctttgtgcttaagagtatccaaacagattttagcaaaagtcattgacaggcttctgggaaaatacttcaaagggaactgactcagttgactgcttttacccttcccccttttctccctctggctatctggaatgtgggcatgatggccagaactccagcaattatcttgtgaatatgaggtggtcttgaggatagaaagcctggcctaagaaaagtagatcaaaaagacaggatctccctctgagcctggcacacagtgggcatataataaatatgtgctgaatgcactatacattaaacaaattccatttaagatctagcaaaatccctagaaaaaaatattgatatatatgattgagcccatgctgcaggtaaagctgagccactgatgactgtatgaatatcatacaagcccttcgctacctacctcaacatttattttctacgagagaaagatgcacctctatcttaaatgactagtagcttgggtttacaagcagctgaacctaattgcaattgatataaacagttatcaggttgtatgacttcctttttaaaaaacttgtcttaggctgacacagtggcacattcctgtaatcccagcatttgaggaagccaaagcgggaggatcacttgaactgggaaagtcgaggctgcagtgagctgagatcgtaccactgcactccatctgggcaacagagtgagaccctgtctcaaaaacagacaaaaaacttgtcttgccatactgcacattatttggcagttagatatctcactaagtcatagtccagagcatcaactgattccttgggaatgctcaacaacccattcactttccaccatcacctcaccctcctactcaacaagagttcttctcaactcttcacaaacttttaacccctttatctacccccactcaaatctaagcagaagatctcagaaaaaataaagtagaaatcatcagataaaggctgccacagccgcctccaccaaatcctcaaacccacttgtacttttgagtcagtacagagtaagaacccagttccagattcagaaagacctggttgaaatcccagctctgctatccacttgctgagaaatcttgggaagatcccttaccctaagtttcaattcctcatctataaaatgggagtaattgttgtatttatactccctgagctttcaaaaggattaaatgagataatttttcagcatttttttttttatttcttgagatggagtttcgctcttgttgtccacgctggagtgtaatggcgccatctcagctcactgcagcctccgcctcccaggttcaagtgattctcctgcctcagcctcccgagtagctgggattacatgtatgtgccaccacacccagctgatttttatatttttagtagatgtggggtttcgccatgttggccaggctggtctcggactcctggcagcaggtgattcacccccctcggcctcccaaagtgctgggattacatgcatgagccaccatgcccagccaattttttggcatattttaacacaatgcctggaacacagaaagcactgaaacaattttagttcacactgtatttaagtctacatcatattacactatatttaagtctatatcatcatatctgtcaatatcaccacaatgcaaagagcctggcacacagtgggcacataataactatttgctgaaggcactatacattaaacaaatttcatttaaaatctaggggaaacgctaggaaaaactattgatacatatgttggggcccatgctgcaggtagagagacagagatgtgtctgtgcaacttccttagagtcacatcattagctgaaagaggcaatcacattctctgaattcctgttgtcttctctgggcatagcaacatattatagtataattccttaaaacttggtatggaaatgcactagttagctgattttaagagttatcttgttctgaactggctaactgagagaacattgagaggtaccacaaaacaaacgatgcctcactcataagagaagccagataaaaattaatagagcggccaggcacggtggctcacgcctgtaatcccagcactttgggaggccgaggcgggtggatcacaaggtcaggagatcgagaccatcctggctaacacggtgaaaccccgtctctattaaaaaaataccaaaaaattagccgggtgtggtggcgggtgcctgtagtcccagctactcgggaggctgaggcaggagaatggtgtgaacccgggaggtggagcttgcagtgagccgagatcgtgccgctgcactctagcctgggcgacagagcgagactccgtctcaaaaaagaaaaaaaattaagagagcaagataagaatttattcattcaaaatataaatacattatattagtgacatatcactttaaaagaaatgatgagactctggctcttgtaacagagttggggcacttgagataagattcataggaagagagtataagtaagtaattccacaggactctgcagagaagttttaagaaacaacacgaaaagaatttttaaaatcaccctcccatatacaaagtcagagaagataaagatctatacatacacactcatgcccagaagtgaaagcgaataaggaagtaccaatgaaatggggttcaggcagactgcaaagcagcatgcactccccaacccttccaggagttaagctgggcaattgataagtatgctaaaaaaggcaaaagggcataaaaacacatgctcaagtatgtatggcctatgagaagtacaatacaacatggagggaatgaacacaaatgtagttctcatttgtctgaagtcatgtagagggatgcagaatgtcaggaatttcttaccatatcttgtcacttagtaaagaaaacaaacaaacacagaatgtcaggaatttccaaacctggagaatatactacgaatatagattatactataatctactacaatatactagattatagtaatacctgtttttttgtttgtttgttttttcagacggagtttcactcttgtttcccaggctggagtgcaatggagcgatcttggctcactgcaacctccacctccccggttcaagggattctcctacctcagcctcccaagtagctgggattacaggcatgcgccaccacacctggctaattttctatttttagtagagacagtgtttctccaagttggtcaggctggtctcaaactcctgatctcaagtgatccacccaccccggccttccaaagtgctgggattataggcgtgagccactgcgcccagccagtaatacctgtttaagaaaatttctgaaaaataaaaagaagcagtatgaaagaatgaattctgattaataaataagctgtttattagatattttaatccaagactaatgataatagacatactaagaggtgaatggacagactttcctcaacacaggcgactgaaacattctgcaaggagtgcttctttcctcaatgttagcaaagtcattaccccacaaagtcactgaggaggcttttgtttaaaattctcagtgttctacagtcaatgttaccagttcctctgacaataacttcagttttttacgtgtaataatgttctccaccacctaaggagagattactttaaattttttctccctattccaaatagcccattagcaaaataaaggcctgttcaggacttacgatacccccatagctcgaagctagctactgcctaaaatcaaacttttaaaataagcctgctgttctcaattatccttaattcctcgcctgctggaagtactgcagtgaagctgagaaacctgagttcgagttctgcctccatcatttactgtcactgaaatgacagaccactgccctgcaagtgtggcttcaggttttcccagttatggaacagaagggttaggctggatggtctttcaagtcctttctaaatgtgctgtcaagttatgctatgtgactttagtcttcaatttgcatatttggttagtaggccttcaagttattttccttcagacactaaagagggcaatttgtgaggtgcccagtctatgccgtgtgctacacacaagctgactctcattcagcatggaatagtgagacaaggcacatttcactaggccacatttttccactagaaatataactctattaaaataacaaagcactaataatatcacaaatcacaccactaagagcaaagaaaaaaataaaagcatgcaggcacagtaggatatgaactacttaatctaatcacaatattctcccaaatctaattagaatgctcatcattcattcatcaatgatttattaaatgtgcactatgtgttaggtgctacgctaagtattcttagtgagtgaaagggcttctacgacatagacaccactccaacttgttacattatatcatggtttcacagcttttctgacatcaaaaatcctttattacttgtctataccctccaggtgagaaggaattaactgacctccttagatttcttaccttagagagccatccaagtattcaagcctgtgagctactgttatacatccctttattattgcattgtcctttcaagaatcattaatgattttggctccaagaaatattacttcaataagtatgtgtggtatgctcagtgtgtgtcaggcaatgtgtcagatgttagagatacacagccaacaaagcagcaaaaaatgtccccactcctctagagcttataatagaacacatattgattgaagataaataagatcaataagacatgtccctatgctcttcatcatccctgccttatcattcatttctgtgaccagcccatgggtttcagtttttgaaacacagtaggaacaccgtcaatattttctaagtgaaaagtttcagtccctctctgtttccagccacgggaaggaaattgccactccatagaacttgggtgcagccagtaaggaacaaattaggactcatgaataaaatatctctagttgtttctatagacttaacatgtaagaggggttacccacctcgtatccaccctccctcttcctcttttctaatggagacatgatttagttcaggcttcccctctacagtgcagcctatcattctcagggggaacaatcctattcccaaacccaatgctaagtccagatagcctacttttatcatgatcattttattagccttggtgataatggttcaggagtgagtacatgacctatgttagtcagactgaaggaaagaaaagatttttagtctctgattggagaagatgttctttctcccactgcaattagggacaattgctgctgctggcagcaattatcttgtgaccagagtggaagccaatttaagaaaaatgaagacacagaatagagcagagctgaggtcccagagaaatggagcaaggcactgtctgcgctccggacttcagttgtgtttgatcacatccctgtttattgtttatgccagttttagtggtgttttctcttacttacagttaaagtatccccatataaacctctggtaaatattgcttgaactccaaattaggagaaaagaaaatgtgcttttaacacaggtacattttaaaatgtaaattctgatcagaaggagagcatatatcctctaagacccagtcggagagtaaagcatctgtgattattgttgggaaaggaaaacaatatttatcacaattaatttataagattcttttccctctctctaacctttgtgtttaatattctccagaacacttagaagtactttacttttaaagccctttctttgaattgaccaggagtttccttgaattaaaagcaacataaaataatctactttggacaattcattcattcatttaaaaaaaaaggctaacaataaatcattcaagaatgaagagcctttaagagaatcatggatcacaagcccatggctaaaaaataccttacagattgtctacattaatgcttttgaaagttttccactgaaattcatgtaggaagcgtttctatgggtgtggaaatagtgtctgaagtagcttgtcaaaagcatgaaatatcttggcatttgactttttaatcttaaaaatgcaagaggaatttgtattctagtgcagaatattattgacatatacattttcccaaacccttagtgaaattaataatccaggaagctgcacaatatctgtctatactgtggctctgggttgacgtttactgggacaccactgtgtatccccagggaaagatggtatgtttacccaagtgcaagtgtacatctccagaccattaccctcatgtcatggaccagagaactgaagtcaagaaaggttaaataacttgcccaaagttctcaagatagttattggtagagctgagaacagaaccaagcctcattctaactcccaagaatagcagtctctccaaatgcttcttccagtctttgtgtgaaaataagaacccagattagaagtttagctacagctctaaccacatatgtgaggctacagatcacttcttgaacatgccctgcacctcaatgcctttgtttgcttctctctaaaggctcttctaactctgcatggctggtttcatcctatcactcatgtctcacctcaaacatcacttcagagaagccaccctgaccaccctacctaactggggaatcccccaactccagtttctctctaccatatatgacttggttccttcacaagacatatcatgatataaaattaccttatgtacatattcattcccctgtatattgtctggcttcctccctcttgaacacaagctcagtaaaggaacagatcatttctgtcttgctcactgttcaaaccaaaattggaggttcacatatggaagatgatgcaaaacatttttgaatcataagtgaataccctacactctcatatctctccgtcctgatccaacctgccactctcctagaatacctttcctccttcatatttgcctgctcaagtattacctgttctaagcacaactgaaatcttatgtctaccaagaagcctcctctacatctatgtatctgactaccttatgaggatactgacaacaagaaacttgtcttattcacatttgcattcctacatcctgacataggtggacctttgagctcagtccttcacttctgtcacctgctcatctgccttccttatctcagtgccttttttctctgtgttccagaagactattttatgagtatcctacttatgattgactacatttttcattatgccaattctgttccttaaacactccaatgtaaattttaattcgccatttcatttgcttggcttattttttcccttgccatcttttgctcatgttgcccagttacccaggttctctctctctctctctttttttttttttttacgtcaatgcatactttcttttggcctttatactcttttttttttattattacactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatgttccccttcctgtgtccatgtgttctcattgttcaattcccacctatgagtgagaacatgcgatgtttggttttttgttcttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacttgtgcatgtgtctttatagcggagactctcccctcactagtcaatttagaatgtctgaagtttatctgaaatagcatgttatttcctgcaaaagaatatgtatgttcagaagtacaatctttttctaatccttaagcttgatgactctttcccttaacctgccctgttattttatgagccccaaatttaggatttactctgttttcatcctagagggaggagagttctatccagactcatgtgttgaccaaacaagtgatttagagagctcttagcctctaaatctgattgccagggagcagattgaatcccagacttaaagcaaagggaagatacatgtgctgtatctatcttggctccaggattctagtctaatttagagtagtttagatggttaggtgggatcctctcctaactcatcaaagagcaaaatattttttaaaatgcaatgcactccccagctagctctacactttgttctgccctgttgttttccgaacttactgtcttcaactagatattgactgtcaagaggacagaattaaagcctcttcacaagaaagaaaataaaagggaaaagcaaaaggctaagaattgaatcttaaaattgctaactttaagaactagaggaagagagggaaaggagaagcagtcagagagcatgatgctgaccagcccgtgtcacagggatgccctgaggcagagggagcactgaaatactgcagagggacaaccatcaatgccaatgatctcatcaaggaaaaagaatgaacactgcgtgattaggaggcccctgacatccttggaattatcagaagaagaataacaaagaatatcactctggcaggtgattaagcaatgagtagaataatgaagaaagggaaactagggcatgcttgttgaggaagacggacagagaaaaacaagggagaaatagatcgtagtcatctaataaatatgagagatgttaaaatctacatgcactatttaaatctctaagcaaaaataataggcattattgccctttttgagtttggaaaaactatctcaggcttagaaaatagtgaaagcaaccattatgtaaatcctcttttaaataaagggacacaagagaaatgagaggggataaattcaaccccagaaattagaaatctgagaatattagataaaataccagagaagaaacattatgactcaagattccgtgatttttttaacactatccaaaaatgtctttcttaactctgctgaatcactgtgaaatttcaggacctctctttttaatattttgttaaatttttatatggccccaatattggctatgggttatgtgccaatttttgaaggcttcttacaaccaaacaaacatttgtatggtttgtggctaagcattatcacagacattgaaaattaagattatggtagaataaaagtaaaattcttttgaatagtcgtaaaaatatatgtatttttacaagtaataagccattaaatatttcctttcatatctccatcaaagatctattcttattaactacaacccagcaatattaaataaatataaaggctcctggccaccaatataaaggctcctggccacaaatttgaaaaaggtggtaggacccaagaattaagtgtatcatgtatctcagttatgagctacaaccccaaagaaagcctcatgatgttcttccatccaggagcaacaaaagttgcaaccacagacattcatcccattagtcgaactgtttattaatacctaactgattttactccattagtcatttgagaaagttaataaactagaaaccctatcactctatgaactaattcctaacctgcaaagaaatcatcatgatcatacaccagctgcttcaatattttaacattacacaagggattcactgaaagaagtatttgttgagggctcctctgtgccaggctctgagacttaagcgaataggtcacttaattggacatcaaccctgaattgagtctcttagtcaagtgagcagaaggataggattatttaaaaaaaaaaaaaaattccgaggagctaaaatcagagggaaagactatagattatcaatgttttttgtttttgttttttgtttttttagatggagtgtcactctgttgcccaggctggagtgcagtggcatgatctcggctcattgcaatctctgccatctgggttcaagcgattctcctgcctcagcctcccaagtaactaggactgcaggcgcctgccaccgcgcccagctaatttttgtgtttttactagagacagggtttcaccatcttggccaggctagtcttgaacccctgacctcgtgatccacctgcctggacctcccaaagtgctgggattacaggtgtgagccaccgtgcccagcccaatatcagtgtattttaatggcaatgaaactagcaaggaatgatattgttcctataggtaacgagttccattttattaacaatctttcatatgtgtaatatctttcagcctttagcctaatttttcttctggatactggacttactggctgagcataaatttccaaagcaaactaactcttgctgatgtaatgtaacttctttcttgaatacagtcaacacaaactgaggctggcaccacttttccaagttttatcccaatataaaggcatgactaagtatgtacctcttcccagaggagctgcatagaggttcaggatcatcaacacattaattctccagagaaatccacaataaaagatgagatcacttctgcacaattaagctaaaaataaattgtcttatatggaaaccactgctgagatttttctaaaacataactctagtctttgggtaatattagcttaacattttgtagattttgaaatgtatttactatactaaatgcagaatatctattattaagctttttcccttatacagtttaaccagggtatacatgttattcatatttagttcatccaaaaaaatttaattgaggggctactatataccaggcatttttctaggctctaaggacacaataatgaaatgaaatgaaaaaagccacatctctgccctcagggagcttatattttagtgaatagatacataaatgtacattcatacccataaataaaccacctacatatatagtacaataatgtttattcatgtcaagctggaatttgcttcccttctaaacttgcaaatatttgaatagggatctaaacatgtcactaagcagcctctattctgcataatattaagctatagtccagatctaagtattcagatttacataatagtactcagggaacccttttttcctagaataagttgttttttgataacctttaccttgttacctctaacagaatctctttttttaattcctaactctactatcctcccacagcagcattactcattctcctaaagtgtacaaaacatgttctctcacaattcatattcccacaagagcaccttgttttaatggtactttcttgttgttcttgatctcctttttgaaaagacctccaaggtctactaacatggcacatgatgtgatcacttcttctttttttcaggtcatttcttacaactcacttgacaatccacagaactgcttctgtttctcaagcacatcatgcaacatctcacctctaggtctctgctcatgtcttactgactgcctggaaaaatctttcattatgcccttgcccggaaaaacatctattcatccttaaacactttagttcagacattatctcctccaagaaactttccctgacccagtatctctactccctggggttcgtttaagttctcttctgtgcttccacaatacatgagaaataactacatcacttaaacttaccacactgtacagtaatcatttagctgcagatctgaaaggggcgatacagtcctggtcctgtttgttagcatggtttcacacaatgcccttcacatgccaaagacacaaaaaacaggtttgctgaataaacacttgaatgaatttttaaaatacttcaataaatttttaacagtaaaaatagcaagtgaaaaatacttgtgaaatgatcaagttctgtctaccatggaatatttaactctctgtgcaatgtttttcttcttttccaaccaagctatttatttagctttttaactagatatcaaacacaagtaagtgcttgtttaaacttgaaaaatcctacagggatcgtggacgatgatggaggagacacagtaagcaactgaacaaatatctgttgtgagatttaccctgtgcccaggagacaccagaaagaacttcattagcaaagatcttccttcttctatgaggtaatgaaaggggaattgccaaagccctcgagccaaggaatgggtgacatcaactttatcctcagtgatttaaatgtgtctacaatgccatgtcttccagaaaaggcttgaatcagaaacatgagttaaacacatttcatttattgttctcttgtatcctcagcagctacctctctaacaaagagatgaacttgtgctttgactgtgaagattttcttcataggactttttggcctcaattagttgctatattcctatctctgggccagcattcctataataaaatttataaaccaaacagtttttaagtttctgtttgttgtataaataatgtgtctggtcctcatcccaggttcctgggatgaaagcttctaagcccttggaatttctaaattgatagaagtctccattatttctggtagattctcagaccacacgtaggttccacaatatgagtagctaaatgagtagctaatgaagctactcatggtaggcccctagataatttcaggatgggggctgccaagctagaaagaccaattatgtgattaaagggttggggctttgagtcaggtgatattagccctacttgtggggagaggaaaaggtctaatgattgagttcagtcgtgtggctaatgattcaatcaatcatggccattgataaaagaacttcagccaaattaaatttaaaggagtttaattgagcaatgaatgattcacaaattgggcagccctcagaatcacggcagattcacagagactccaggggtgccttatggtcagaacaaatttatagacaaaaaaggtaaagtgacgtacaggaatcggaagtgaggtacagaaacagtgagattggttacagctctgcctttgccttatttgaacacagtttaaatattcagcagtctatgagtggttgaagtatggctgctgggattggccaacactcagttattgttaaaggtgcatactattaagttaggttttcaattttgtctgactattaagataggttacagttcatccacaaggattcaaatatagaagtacagagaccttctcaggccatatttagtctgctttaacaccatgtaatgaaacaaacaaacaaacaacaacaacaaaaactctgaacaccaagtctccagtgagctctctggtaggtaggtgaacacattgatgtgcccagggggcagtgtgtcctgatcctaaagggagaataagctgagcccctaggctcaggcttgtaatctcagaactttgggaggccaaggcaagaggatctcttgagcccagaagtttgagaccagcctgggcaacatagtgagaccttgtctctacaaaaaacagaaaaacaaaaatcagccgagcatggtggcattcacctgtagtcccagcttttcaggaggctgaggcaggaggatcacttgagcccaggaggtagaggctgcagtgagccatgatcataccactgtactccggcctgtgtaacagagcaagaccctgtctccaaaaaaaaaaaaaaaaaaaaaggtggagagaatacatgaaagttctgtgttctagactcttccagacctggtcctttatgtctcttcattttattggttctgatttgtatgctttataataaaaatgtagccctaagcacagtgctttcctgagttctgtcagtcattctagtgaattatcaaacctgagggaaaccccgaatttgtagttggtcagaaatgcaggtggcctgggcacccctgagcttgtgactggcatctgtagtaagggtgttcttgctggggtctctgtacttaacctagggaatctgtctaactcttaggggaatttagcattagaactgcattaaagcattacaccatgccaccagggtaaccacaaaattagcatgcgtattcagcatgaacaaaaaaatggcaggcctagaggcaggatacctgggtccagggtcaaacctcccattttagagcttgacgttgggaaagccacaaaactgttctgagtgtcaattttctcatcagtgagtggggctggacttggtggcttctgccatttcctgttttattactgcttccattaatcatctatttggaggaaaaaccaattatcacttttttctctggacgatttttctctgttggcttctcatattagcaaaagcttgaaggtagatttgaggccttcgcacttgctgttccctctacctgaaacattcctccccgagatacctgagtggctcactgcctaacttcctccagtgctgtgcataaatgtcatttctctgctgatccttgttggccatattatctaattttaaactctacccctgacacttggccacctttctcagctttattttactccatgacatttatcactgactgacatactacatgtgacaatggcttttctcatctgctccgccagtagaacgtaagctccatgagagcaagggtctgtgttgtgtgtccactgctttatcctcagcacctagaaaagtgcataacaaataaatagctgatgtttaataaatatttgacatatggatcaatggtagtttttctgagatctggtaggcacaacaatttaattaagtaatacacaagctcatacctaaaataactgtaaaaatgattccccccaaattcaaaaaaaattggagaaagggtgtgagaatagatgataacagaatgctattcatcacagtcagaggaaagaattatggggcttaagagattttagagtggagatgatattatggtgataggtaaagtggagatgtgataagacattgagagatcacaatctctcaatagatattagagtttccaaagatgatagcagagaaaggggcagttgatgctacaataattgacaaaagtgaaaaattatcttattggtcatagtaaagattacaacaaacaggtggtataagggaaaggctctgaaatattgagaaattgcagaggaaacatgatttaaaccaggtgtccaatatagtaacaattagacataagggacaattgagcacttgaactatagctagtctgaattgaaacatattattgaagtataaaataaataccagatttcaaagatttagtataaataaaagaataaaacacaacctgttaatttttatattcgtttcatgttaaaataatttttggccaggcacagtggctcatacctgtaatcccagcactttgggaggccaaggcaggcggattgcaaggtcaagagatcaagaccatcctggccaacatggtgaagcactgtctctactaaaaatacaaaaattagctgggcatggtggcacacgcctgtagtcccagctacttgggaggctgaggcaggaaaattgcttgaacccgggaggtgaggtcacagtgagacgagatcatgccacggcattccagcctggtgacagaacgagactccgtttcaataataataataatgataataataatttttgatgtgttaggctaaataaaacacataattaaaattaatttcactgtttatttttatgttttaataccaccaatagaaaattctaagtgacatatggaggccagaattatatttctgttggcagcactaatctagaagggttcgaggggtatgtaaggaattctgcagatttgataccagcccccaagaacctagagaactaagagaaggcagggcctccactagaaaggtttgccagagaagcagtatcttccagagaaagcagagtttcaggccaggcatagtggctcatgcctgtaatcccagcactttgggaggccaaggcgggcagatcaccaggtcaggagatcaagaccatcctggccaacatggtgaaaccccatctccactaaaaatacaaaaattagccaggcgtggtggtgcatgcctgtagtcccagctactctggaggctgaggcaggagaattgcttgaacctgggaggtggaggttgcagtaagccgagatggtgccattgcactcccacctgggcaatagagcaagactgtctcaaaagaaaaaaaaaagagagaaagcagaatttcaacaccagggagcaggtaaagcggctggaggaaaaagggggtatagttgaggtatcagaggcaagttggtagatcaaatcacaggagaggtagagactttgaaattcatctgccctatactagttctaaagctgagagcagttcccttagttaagaccagctttatctgagaagatggggtggatgaataagttgtcaggtgtgatacagttaattggctgggcatggtggctcatgcctgtaatcctggcactttggggagactgaggtggaggattgagaccaggagttcagggctgcagtgagctacgatcacatcacagcacactaacctgggcgacagagcaagaccctgtctcaaaaacaaaaacagttaatcaacaaacatttattagagactctgtacatcctaggctctagggatctaaaaatgaatatgttcctgccctcaaattgttctcaaagtagcaggagaggtaagtatatacaactagataaattcaatacatatcctggcaaacacagtaactaagtaaaagttaggccctgaagtcagagccaagagtgagacatacacaatttatatcctgtatgctatcattccaactggggcatgggctgtagaaacagttcattcagcataattttcattctagctacaaaagagtcatgccatcttttacttaaaaacattaaagctttcgtctgccaaaaaaaaaagtattcccatgaaaccatggagttctctaggtatcaagggaaatatcttagagttcacaaatgtattccactacctctcattaaaactgtaactatacttcattcaaaaacttcaaatataccagtatacattctccaatgttatttttagatgcctttatataaaacaaaatgtgcatatgacactacctcctttcactataataaagtgaaacaagatgccatatggttacaagagactaacatttcttttgttttcttgatatctttcaaaaaatacaatataatttatttagtatagttaatttctaaaaggtataatatgaaacagcaaaatcttattagtagaaaaaaatcagactatgtataccttttgggtttttttttaatcatctcttcaatggcaccacaacaaaggtgaggataacaatgataacaacctgtgtacgtgtgtgtgtgtgtttggagctcatgccggcaagaggcactggtcattcaaataacagaaatgaagatacacatcacactcctattgcttattaaatttgggatcttgggcaagtcaatccacttcttagaacttcaatctcatcaccaagataacagggataatatgcaccatgaaattaaatgagaattctggcatatagtaggtgcgctcagtgagtgttactatctgatccctttcctttcctccaaaccccactgcactcccaacctagtcacggccacctacacccaaaagaatgacaaaattataccaatcagcaccttgtagactgcttcttgatattattctcctaaaggtggcagtgcatcagtaaaggcagccaatcatatactatgtattaaaatgaaagaacatggttttcaggataaaattcttattagtttctattaaaagttaactacttgaggattttctagcaaaattaatccaagctacttgaatggtccttgaaagcaggaaaatcatcagggtcattacagactattgattcattttctacaaagttaaaaagcaaattatagaaagttttgatgagaatcttgtccttatcagcatgagtaatggttcataaatttcgcccactaaattccaacaatctaaaattcaacaggagaatgtcttctaataacaccacagggtgtgttttcaacagaaaaataacctgctttaaattctttgtggaaaaaaagtgagctataaatttaatatattttatttagtaaaattttccatttctgatatcagtttttttagttgaataagtagaatttccaccaaaaaagctcctaaagaaaacaatatgcattttattaaaataaatcacaatgctaaacacaatctccaatgaatagggcatttgatgaatgtgcaggaaatgaaaaatagtaaaagcaagtaggccttaacaacacgttcaatgagactgtatattaattcatgtgattaaaaaaaaaaactccattcagggcaggtggtttaagaggccctgagaacagtgacttgcccagggtcacacttcctaagtggcagagcctagactgtaacccaaatctgtagattcatttccccaccttaaaaatcagtattgaaacaccccatggaggttacaatttcagtcttctaggccacactggaatcttatcaatagcatgaatgacatgtggttatttagtctctgtttaacagttccaatgactcaccccttttataaggtcactgttgccatttctgaaatgtcttctttacgatgaatctaaatcttgtctccagttaatgttgtgctttggtcctgagctacatagcataaatctaatccacaaaagagctggtcccctaaagctttttctacttcaaagctacacattccttcaactcatgtggctttaccgtgaggagctgctacaggtgtcatttgatgcctgaaaacccttgctcatttcttccttcccattacatcttcccaccttttcattttcatttcataccacccctgagatatccaaaacaggatcataaatatactgataattaaaaggatgtacaattaaatggcagccagtaacgtaatcatgatcctcctgaattattcattgttctgacatatctagcactattcagtggaggattgtttacaatccatatctgtaaatttatcagatctcttcagctttgacattcatccaatcgcacagcaaacatttattgaaaactaactacatgtcacatcttaacctaggccctgttgcaggcactacccatagaggaatcaataaaacagaatttctactctgaaaccagggaatgttattatatctgctagctttcatagaacacttacaggcacagttctaggtgctttgcatgtactaattcatttaatcctgacaatgactatagataggtattgttgtgttcattattttctgataagataaatgcattccatcaaggttgaggaatttatgcaaggtctccaagctagttgtggctgccactagcggatcagggatgaattccaaattaagtggtttttctttcttttcccatcccttttcaatttttctgttcttattttttttttcctggctgcccagtgtcttcacttatgctaagtaatgtgaggttttcttcattcacaaaactacatttgtgtgtagatgactgccaagcataacattgctacttctgttcttcttcccactttctttgatccacttcctctcccgtacatacaaatgaccaaggtcagtaaaggggcaccctaactttgacttgacacacgaactgaacaataaggtatattttaaatagtctgtgggtgtgatatctcagagcacctgttactaatcacacctggcatccttcatttcatgcagcatgggttagttgggaggaagggcgtttcagaataagcagtgtgtgctatgatactgaagacttcaattgtaagtggtgcattgtgagcctgtgacttggtaaagagggggcagtgtaatggactgcatgtttgtgtcccctcaaaatttatatgttgaaatcctaacccctaatggcatggtattaggaggcggagcttttgggaggtgattaggtcatgagagtagaaccctcgtgaatacgactgtgcctttataagaagaaacagcagaaagcttgctacttctctctccggtctctaccgtgtgaggataggagaagatggccatctgtaaaccagaaggcgggccctcaccagacactggatctgctgccaccttatcttggacttcccaggctccagaactgttgagagttaaatattggttgtttaagccgcccagtctgcagtattctaatagccccaatggactaaaagaggtacaaatgtaaaaatttgggagattcttttgttgctaattttgtcttctaatcttatctagaatctattcatcttctaatacacatcttctaatgaactaatcttgaatttttctggttaactcctcagctgaaggggttaacccaaagagagaatggtgcagcttataagtagtaagggtcttgaacagcagggggcctagcacctctccagagagccagagatgggaaagcttgagaaattccaggaacaaatgcccacttgggatgaggagagagagcacggtcaaggaagaagtttctgttgagaggatatttgagtgatgtgagcaactacagtgtatgtaacaacataactgatatttataaattaatttctttctatttaaatggatataggcattaaagacatccttatttaaaagacagcattaaaaatacagtttcatgtttctcttttctgtgaaattgcttcagttgataacaaacacaaaaggaaagaaaggcagtatgcatgcctctattcaattttttcaaggaaagcagcattgcagtaagtacatttacagatcattctgcttgtgaaatttcatttgatagctaccacaataatcttttaaatctctggaccatagaatagttggaaagttttcaggtgtgtttgctttttaattaaaaggatgtcctgtggtccctaaaaatgcaatgtaactaagaatgtactaaaacggtgtgagaatttgattcaatatatttgactcaatatattcttagttgctaagttccctctgtatcagttagaagcaggcagcagagtcctatataacattctcataggttaagtattttcttaagattcacttgacccaggtaagaaaaaataatattctttaaatctatcatctctaatctttcaccgatgtcctgaaataatcaataattgtaactgccagggtttgcaaaggttgctataatgacttacattagcatgaatttttccaaataaaacttcagtgggtacaggaactgatgcctttctctaatgttgttgacagaaaggactttcagaggttgctgtgttgtgaaacagtactcattttagctggggcatctcatttacccttcaggcttttgatctgctaataaagggactcgataatctcaaaggtcctcccagctctcatacactatgattctgtgacttgtgcatgacttggtttccccctttacagagttagagcgtgactgatagcctgatcctgaggctgctacaaaaagtctatcttttcagtgtaaaaggctatatgtccttttaagtaaatgtgacatatggcttgaaattcaagttgataggatactgatccaccttagttagagcattttacatttttgacagggcactttgctgaacagaatgtcagtatattcactgcagcagtgaagaaaacgtgggggtggaggggtgggggtgccattctgagggaaagaaggcacttaaggaactctgagatgtgtgagaaagtcctgcagcctgaggagctgatggaaagagggtaggggtgaaaacaggaaggtaacacataaggtccgaaagggaaagggaacagcctgatgtaatgcagagcccaggaagtcactcagaggactgctactgggccatttcacaccctttcctcaccaaaagtttaaaaggcaaattacgcaggtgttttgttgtttgttttgttttgttttttgagacagagtctcactttgttgcccaggctagagtacagtggcacgctcttggctcactgcaacctctgccacccaggttcaggcaattctcgtgcctcagcctcccgagaaactgggattacaggcatgtgccaccacgcccagctaatttttgtatttttagtagagacagggttttgtcttgttggccagggtggtctagaactcctggcctcacgtgacccacccaccttggcctcccaaagtgctgggattacagatgtgagccaccgtgcccagcctaaattatgcaggtttttaatatggaattgccattctcttttgttttctttttttaatatcttatttactttttcaaaaaacttttatgttaggttcaggagtccatgtgcaggtttgttatctaggtaaattgtgtgtcgtggcagtttggcgtacagattattttgtcacccagttaataagcacagtagccaacaggtagttttttagtttcactacaaaaacatttatgtaactgctgtaataaacacagagcctgcactaacctgttcttgtgttgctataaagaattatctgaggctgagtaatttataaagaaaagagtgtttaattggcttacgatttggcaggctgtgcaggaagcatggtgctgccacctgcgcagcttctggggaggccttaggaagcttacaatcacagcaaggggagaagtcctctcacatggcaaaggcaaaagcagaagcaagagagtgggagggggtgggaggtgccacatactttgaaacaaccacatcttgtgagaactcacctactattgcaaggactgccaagccatgagggatctgcccccatgacccacacacctcccatcagttcccacctctcacactggggattacatttcaacacgagatttgggaagacaaatatctaaactatatctgagcccaggtgtcctcgtcaaccatggaatcctttaaaggagaagtttggctcaaacctccattccacatcctatgaaaaaaatccaatatcctcctcaacattttagcaaacgttggagtcttaggtgctgtggcctctatttcccacttctgctaaattctcatccatagctcaacactgagcagctatttttttcatgaacctcagcaaaggcccagatgcccaattcctcaattcctccccttccttcttcctgctacacagttatttacagctcttgcacttagcacaaagcttggtggtgagcaagagaggttactgcccagcactgcccagtcaacaactcaatgttttcttaaaagacctttctatttctttccttttcaaaaattctgacatggccattccacctgggtccctcactatttgcttgctcttctttccccactccacttcccagaatgtgcaagaaaattctaaattattttactctcttatttagggcaattcagttctctccaggcctgtcttatcaaatcaattccaggcccagctttagataacctaaacccagtagaggtcctgagattgcagactatccttaaaaatgatcaacaatccctaggtagcagttgtggttctaaatattgatatttttctattacaaatatattcaaatatattccctaaatgatgaacatcaatttttaaacaagagttaggctaaatatattacaatgactttcaaacagtggtaccaggagtgtattattcttcatatactttaatatagttattctcaaattttagctagcatcagaatggaagactggctaaaacacagattgcagggcccccttgccagagcttctgtgtcagtaggtttgaaagactgcactgcacacacatcccaggtgttgtcaatatgtccctttaaaaaccaatgcttgggctggccatggtagtttacgcctgtaattccagcactttgggaggcagcgggggtcggggggtggggtgggggatggggggggtgtgggggctggggggggcggcatggatcactggaagtcaggagttcaagaccagttggccaacatgatgaaatgctgtctctactaaaagtaaaaaaaaattagccaggcgtggtggttggcacctgtaatcccagctacttgggaggctgaggcaggagaattgctcgaccccaggaggcggaggttgtggtgaaccgagatcgcaccactgcactgcagcctgggcaacaagagcaaaactccatctcaaaaaaaaaaaaacctgcttagcagaagttctcatccccatatccccatcacctgagggaggcaggaagcttatctccgcacttttagacggaggcagacaggaagctcatctcctcgcttttatcatataatggctggagccttctgctgaaagtgtaggtagcaaatactttcacctgtcccctttcagcccacatatggtgatgaatcatcctgttcccagagattctacttctacttcctgtaagatctactgaatgaggactggtgtggtctgcatattaatcatccctcccagacccctgtcatcatagtagccataaggatatgctcagcccttacgttgtaaatgtgaaagtatttagaagatgatgctcattttccagtcccttggtttctccttaatcactgtgattgttgctgattaatcccaaatgctggtgggagagaatatgtaaaaagagtaaaaactttgaaggagatgaaaacagttgatacggtacatgctgcttcatgagtttagcttgtggatgtgacaataatttttgtactcttctgagcaggtggcagatgggtgacttctggcatagaaaagattaatgctctgatttgatggctgcttccgcaataccatcaacaaggcattgtgaacaagaattctaaccaaaattttagccgctgttcagcatcttttcaatagtaaaacttctcctgcgacaggctatttctgcaggattccttagatttaccaacctgatcaataaccaagtacaagacacaaaaccacagatagtgacaggctctttaagcaacatttgcagctgaaatgaaggaaccatcttcatgttccagggcatgaaggggagttgctcctgcactatctttttcctgcctcctccatcacatatttagttattttcagagccatccttgaggatgcaggacctcgctgcttatcagactcctttataaagtgggttcatctgctcggcatgtcagatcacatcaagatatacaagctgttcccactgtagcagagaaagctgaaaacctaaaaccggatgatgtgtttattcccaaggccagggtttaaagaaagtttacattcaaagaatgatctagaaaactaattttattttaatttactagaaatattttaatactttaaactgccattatatatccttctggaggagcatggacttttagagtccctccttaaacattttttagcaaccttctcagacactgggtttgttagatatccatttgttccttcttctgttcattcttctccacttcacttagctaaatgagctgtggcatgaatatgcttcagaattcttgacatggaaatttattattcagtcatcagatgttattgggaagatactgtgtcttaaggactgtgttatacaaaaagatactcaagatgaatgagtgatgaagaagctcatggactggctcatagaagaagattatgagctgcttcttctgtcttgaagaagctcatagtccaaggaggggagacagatatgtggcaagataagctactgtaaagcaggatgcaggaacagaggaataaatatggcacacaggaaacatgaggcaaggaaggactaactttacctggtaaaatgaagaaaacttcaaatggaggctttgaactgggttccaaaggatacataggtaaatggaagaagagaaagaaaaaggaaagacccctatagagattctatcttttcttcgatttgcattaggaacaaattcctaacttcctaccacagaaaaatgaagctgtagaattttattttatgaaatttgttgtatgtctaacaaattgtagagttttattttacgcctactttcactctcattttaaaccaatgttagagaatcttggttataaattactaaagatgtgttacagctaaaagtctaaactaaaagcatatagtggagctgacacggagaggaaattaaggagcaaaagaaccttacctccaattagccattatttcccatttttcctaccaaattacctaataaaactaatttaaactaatcaaaaagcaagcaattgcttaaattttgttgagaatgttttgtgtatgaaacttcggatatttaagaaaataactcgaacacataattatgggaatcctatataataattttagattattcactattaaaaaaaagaagctgttgggcagagggatgtatgttaacctagttgcacctgattcctagagaaaaaattttgagagttttctataaaggtgtcattcttctgattgggagtaagtcattattctgcagttttactctgaacaactaagctgagaagtcaaatgagaggtctgtgtataattagctccgatagcctgcatgatgtgaatacaaatctgtggctaagatgagacttggcaggcccaacaactaatggtcacaggaaataaataaaggatgaattaaagatgaattaaaaaagtatctattttctctttcttttaaaatcttttctagaagaatgatttgtcttattaaactgtcttgatgacaaattgtcttattttaaaaagtagacacaaaagtgcattaaaggtaatcacccttttctttctgatgggccatggcatatcactgatctgcacccctcaaaagttgactataaatctaagattatgaactgataacactgcatgctcctcctttttttttttttttttttttttttgagatggagtctcgctcagtcgcccaggctggagtgcagtggcgtgatctcggctcactgcaagctctgcctcccagtttcatgtcattctcctgcctcagcccccccgagtagctgggactacaggtgcccgccaccacgcccggctaattttttgtatttttgtatttttagtagagatggggtttcactgtgttagccaagatggtctcaatctcctgacctcgtgatccacccattttggcctcccatagtgctgggattataggcgtgagccaccacgcccggccactacttcctttcaatgttcccactctcatatttgtctttctctattcagaactccatcaaataattatcaaaaactttgtgatctccctgacttatagactgaaagccaaatttaatgaccatgttgcactccatgattttagatacaaaaataaagggaattccaaaacagctaatagttctcaaaattaatatttcaaaatgctagctagtgtacaatttatactaacgtacaatttacaattgtaatacaatttagtgtattaactttcctatattctaaataagtattctagcccctcaaaaacattgtttttgtagtcaaaataatattcttaaattagaaaacctatatccacttttaatcaatttattactcagttttaacatttatatctattaaaagtcatagttctaaaatattttctaaaataaatttttcacagctgtgaaattaaatgagttctaaccaatattaataaataaaatagaatagcataaaatagaaaagatcagaagatgacagaatagaaaccagtagaatatactgcatgtagcaatggaaaatattaaattcctaaagtttgtgtgtgtgtgcgtgtgtctgtgtgtctgtgtgtgtcagtactagatcacaaggtaaaccaggttatagccaaaaatttgacacattaatattcaattttattacatttattaagaaaaaactgttgaatattaaaaagtacatggtcattcatttctatatatttgagacagtggccaatgtgtaggttggtcattatattcatcctataggataaaagctgcttctgaagaaagtgctatgatgtgttgcaacaaaagatcaaccagctcaaatctgccatctggaagacaaatctgcaaatgttttagtatttttggttttcatttagtcatgtgacctttatttatctagacctactttatacaagcaccattttaggcaatggaaggaaaacaatgaacaaaaagtcatgttcccactgtcaaagagcttatagttccgcaaatcttaatcaaataaacttataaataaggctgaattttagctgtgttaaatgctatgaagtctgataaaaacataatgaagactcaactatattaatagcagaatataaaatcttgtgatatagtaatattttactgatattaacaatatttaagtggttttaatttctttgaggatttaaactgagaacttaaggatgagaagtagttaactaagcggagtgaagtatgggctggggaatgagaagaacatttcaggcagagcaaatagcagcacaaaggttctgtggcaggaggcaacagggcacatttctgagaacagaaagaatgaacatgtggctgtaacagagaccatggggagaaacatcttgtgacatgaggttggaggggtcagtgggagccagaccgtacaggaacgtgtggccttgttaaggatttttacttaaaaaggggaacaatacacaatcaaattactgttttaaaaagattgctctggctgcactgtggacaatggttaagtgaggatgtgaaaaactagtctggagattattctagtccctaacagcaatcctcgttgtagtccatttgcaagactctgctagcttagccttgcgtatctggagaggtacataagtggagaagagacttggacagatttgacagccatcagggagtaacataaacaggcgactggatagacttgaaagggtaagtaaaagagaggtgctatcaggttatctcctaggtttctagattacagacctgatgacagtgatgatgaggaagagggttttaaattggcaatggagccaccctagaggcaaagggaagacatttggatagtcaaatttggtgttcagagaagatatctgagctgaagattctaattttgaaattaatagcatattgcaggaaattgatgatagattgaggcataaacaagatgctttagaaagagtgtaaagtgagaagaggagagggcagggaagaagcagggaaggaaagaaaggtcagaggaggggaggggaaaagaaagaagcaacgggattgagccttgagggactgccagatgaacagctgagcagagcagtcagaggagcagccagaacatttgagggaaaaccatgagccaaagtcaagagaagagccagtttcaagaagggagtggccatcagatagaatgctggtgagagactaaacaagaggaagactgaaaagtattctttggatcttatattttgaggttatcagagatcctggtaaaatataaatataaatagattatgtcattaaagcactaagtttctccgttataaatgtcaagagttttaaaacttgagattataaataaaaatcacatgcagtattgtttacaaatggcttactgagacccaattaaagagtaaacaataatctctttttataacaaaagtataaacaccaccaccagaatttgttcatttttctccttattgatcatatcaccttgctcttagctatggtaaaacaggacttaagaacaaaatatgaatggcagaaaacacttactttttttaacacaaaacatgatatttcatctcaatagagttcaaatttctatgactcaatatattcaacatctttcatgaccacaattcaatctgatttgacttctcattaaaaacattctctatttgctgctggatgaatgatttcataaattgcatacatgatccaggcctagaatactgaaaggaacatgattctgatgagtaaacatattctgtttttagtccatttttattgtgcacacttgcaaaattattcaagtttacgattagagctacatgaggacttttaaaaatatgctatatagcttgactatgccacacatagatatttaaattccaaagtttgttgtgtatagctgcaacccaaatcagaagggaaatgttatactgaagtaaattttttaaacatagaaattgtaccatatatacaaagaaatcattcagccagcaacaaatggagaatgccttttcatttaaaacaagaacaaaatagtcatgtattcaaggattcattttatcaatatttattgagtgtctaccatttgtcacaagtgtgaaaaggacagatacaacccaggtgagacaaaaactacgattatgcaaaggctatgaaggaaaaggataaggcaggcagaggtaaacagctggagaggccagaggatgatgatagtaatggtgactctagcagccatcattcattcaggacttaactacttagccaggcacagaggcagcaccccataagaattatctcacttgatcctggcagcaacctgtgaattgggtggcaatgtctcatctccattttaagacaaggaaactaaagcttagagaggcgtgttgtttttgtttgtttttagtgtaaatcacaatgctcacaacggttatccttgagacatctggaaaatataaattctgctcagcaaaataatagagaaggcaggcttttagaaatgctatcaccaaagtatggatataattctcttactgctctgatgctcacgggtattagtggtttcttataaggactcctgttctcaccagggatgacagattaaagaggcagcactataaaagattaggaaaaatgtaaaaaaagaaaagtagacaaaactgaataacactgagtaattctgtatcagctactaaatgacaagccaaagaaagagtgtgtgtcagacacacacacacacaatcgataacctaaataataaggatacggtctttctcagctcctctagtaaaacttcatactcaaaatctggtctcctgtttagcagatttcaacagtgctttccgaccccccaaaactgttaaaaaatattgccaaaacccatcttgtttgcagctgtcacaacatttctctgagaattctccaccgactcctctgcacagagtttgcatttctcctactgggtttcaaggctgtctcttcatgtggacgttgcctttatcacctctcatacttttattttccactatcagtggatctgcctggtccatctaaatcccttctgtctcatctcttcccttctgctaattcttttcctcatgacatcgctattaggttccatcttctaagaacaactttgtaaatcttaactgctgctctcaccaataaaaaattgctgcagagttcagcaatatttgggaaaacaaattcatttgtactaaatggtatagaaaaatgagtatcaaactcttttagctacacagtccttttgtgtgtgcaatttctcctagaatccagccacttaggactagatccctaggagaaagatgaatgtctggttgtggccaagtgtcctggaaccccatccctgtctcaaccacaccagtaagctggtggttctggggtggggagaccatcagtcagtaccaaaaacaaagcctaattaaagaaacttgtcctaagtcaaattaaatatgcagaaccccaaaagtgcctaaagaataatttgtaatccactttcatcggacagtaatatcaaccattcgatgtggaacaaacatttgttaagtgcctactatgtgccaggcactgattttagcacttgagttgcatcagtgaatgcagagattcccttcccttgataagttacaatctggcagagggacacagacatttaaaaagcacataatgaatatataaaatatataatttattagaaggagatacgtgctatgggggaggcagtgggggtgcaaggaggggaggagaaaagaagattgcaagttccaggaagaaggactaaaggaagaaaggcaagttgcatttgcaaagagggtggccgcagaaggcctcattgataaagtgccacttgagcaaagccccaaaggagatgaaggagttagccatgaagacatttaagggggtggtgatatctagtcttaattgatatcttttcatgaacaacttacaatgtgtcatgtaaattgctaaattggtttgcattacacacattatacataaaccatcagaggttggcattattattgtttcacctatgaggatactgggactggagcagtggaatcaccttgagggcttgttaaaacacagattgctgagcctgatcaccaaagtttttaatttgctaaaactgggtttcagcctgagaatttgcatctctaaccagttcgtaggccctgaagcacacacggagaaccactgatttaaaagagataatctctgcaagacctttctatctctaaaactccatattctcatttaaattatatacttcctctttcaaataatagcaccttcatccaaatatttccatttatcatccaactgaaacttataaacaaaatatatattatagtatatattacttttttggttttttttttttttttttttgagtcagagtctcactcttgtcgcccaggctggagtgcagtggtgcaatctcggctcactgcaacctccacctcccaggttcaagagattcccctgccttagcttctccagtagctgggattacaggcgtgcatcaccatgcccggataaatttgtatttttagtagagacagggttcctccatgttggccaggttggtcttgaactcctgacctcaagtgatccacccgcctcggcctcccaaagtgctgggattacaggcgtgagccactgcaccctgcctatactacattatttaacaaaaaaggatcaattggtgagaaaatgaaagctctacaagggaaagcatattacctgttttattcattgagtattcttagcacacagaagagctttcgagtgaattaatgctattatatatcctacattttaaaacctatttattttaaaataagtttggatttacaagagttagttgtgcagataatacaaagagtttccatatgcccttcaagcagcttcctctaatattgccattttaagtaacagttatcaaagctaagaaattaatattgctataattctattaaccaaactcggctttttttgggttttgccaattttcccactaatgtccttttccactcctggacagcatgtcgcattagtcatcgggcctgtttagtgtcttctggtctttccttttttgttatgaccttgaaacttttgaagcaaattgatcaggtattccactggaggtccctcgattggggttttcgctgttgctattttcattaataggctggggttatagactttggagtgtggtgaggtaaattaccctctcatttcaatataccaggagtagatgatatcagcaggatttatcactggagatgctaaacttgatcagctggttaaggtggtatctgccaggtttctccactgtacggttcctccgtttctctttctagaagagtgaatcactaagtacacacttaagggacagagaattgagctccacctcttggaaagaggcatataaatgagtgtagaaagatgttaaagccaccacacaattaataaatgtttaggagaagatacattgaggctatgtacatatcccatttctccttaaattttctcccaggatgatgtcctattttccctgtcccagtgctagaagcagttatttctccttttactagggaatggtatttagaaacaatctgggcactaggcatgtttgtcactactactgggatgtcactgcatcaaggccccctcggcatacagagctgtgcaatatgtgcatatatattagctgacataacatatctatatttatttctgttatctacctgtatatatgtattaaactaaacatgagtccccactgatacctctgactcagtcaacacagggttcactctagccttcctctgttgcttatttttaacttcttcctctgatagtaagaaacctggtgccaagggctgaactgtgtcccccacaaaattcatatgttgaaactctaatctgcaggacctcagactataaccatatttgagatagggtctttaaagaggtaattaaattaaaatacggtcactaggaaggttcccaatccaatatgactggtgttctaaaaagaggatatcaatacagatacatatggggagaagatacatgaagacacaacgagaagatggccatctataagccaaggagagaggcctggaacatagccttccttcgtggttctcagaaggaaccaaccctgccaaacaccttgatctcagacttgtcacaattataattaaataatcaatattgatacattattgttaaccagaggccatactttattcagattttcttagctttaatctaatatatatatatatatatatttcttttttctgttccagcgtctcatccagctttacactctgtacttagtcaccatgtctccttatgcgactcttggctatggcagtttcttagacttctcttgttcttgatgacttgatgagcttgaagttttgagggttacaggtcaggcattttgcaaatgtccctccattgggacttgttagatgtttgtctcatgattagactatggtcataggttctgaagagtaagaccacagagggaaagtgccattttcatcacttcacattaagagcacctactatcaacattaattatcactgttgatattgaccttgatcacatgactgagggagtatatgtcagatttcttcactgtaaacttatttttctcctctttccatactctactctttggaaggaagtcactatgtgtaaaccatacttaagaagtggagatttatagtccatctccttgaaagtgcagtatctgcataaattatctggaacttttctgcttgggtgatttgtctctagccctcatttatttgcttattcaattatgtattttagtacacactcataaatatttattatatattttggattatgattataatataaaattgtttcattgctcaaattgccccatctttggtcattgggagctcttcagttggttcttgtgtctctttgaatgaaatacatggattttgcttgcttatttatttatttacttatagacaggtctcactctgtcacccacgctacagtgcagtggcacaatcatggctcattacagcctggaacttctgggctcaagtgatcctccctcctcagcctcctgagtagctaggagtacaggcaaacaccaccacacctggctaatttttttatagagatggaatcccactgcgtgggccaggctggtcttgaactccttacccaagcgatcctcccatcttggcctccctaagtgctggcattagaagcgtgggccaccatacccagcatttttcgattttgaagactttcttactttgtgggaataaaaaaatgctcctcatcctgtttcctgtgccagcaccagaatcagctgtttctccaaggagccctcatttcttttattggagaatggtattaggaaccaaaatttgggtcctaggtatattctacatttttgacctaacaatctagcataaatagatcttcatgtgaataaatttaagatatcattttcaaagtgcataatattccactgtgtggataaactgtaataccatctattattgatggatacttatattgcttctatgtatttaggtattataaacaatactgagataaactttctggtgtcgaaatcatcatacttgtaactggttatttccttaggataaattgctagaatgggaaatagagtttagggcttttgatgcatattacgaaaggggcttccagagtcccatccgcagagaatgagtgcccagtaccccacacactctccagcatcagatatctattgttattgttactttttaaaataatttcctacgtaatagataaaactttctttatagttgtaatttattcctagatggatgaacaacgtcttaaataggtctttgccatctgaatcaccttttaaaaatgttagtctatattctttccccattttttaattggtatactttttaaaatatttatatgtaagagtgcctgtatatcaaagaaattaactctttgcctgttatatatttaaccatctttctccaatgtgtcatttatctcctaattttttaatggactatttcctttttaaacaataactttcatattccatattctataatttaaactaatttatagttttgtttggttttttgcttaagccacatttacattttgcaattttgcacatgaactaaaaaatgtgtttactttcacagttttgcattatgtgagccaatctaaaaaaaaagcgggtgatgtattattgattctgacacagtcatgaaagcacagattatgcatctattaaaacttatattttatgacatgtttgtcaggtttaatttatgactcatacacatttctggctcggtagccacaaattatctccatttgaatctttatgatacagtacattttcttgccagagtattttttcaaatatcttgatacattgtaaagaaaaacaacaacaaaacccagaaaacaggcaccaaaaattgataaatagaaaatatcattttaaaaagcagcttcaaatatatatgtatctctttccactttcttatttcttaggctagtttaatttttaatttttttaaatattttaggctagtttaatatttttacaaatacatgatcatttttagaaaagtatgtacatagatattcatgttgtcatgtttaattagcttaatataagcatgcatacacaaaaatatgaaaccgatgtcaccatcttcattatagtagcattataatgtaaaatttcaaatgaggagagaaaaaaatatatatatatccttaagtgtagaaaatagctcggagggtgattgggaggaggtaactgggaatattctagtcatgtgcagagacatggatgtaggaagaaatatatggtatgtttaggaaacagaaggaaggtaagtagccacatcacatagattatctagtcttgttaaggatttgggtccttaacctgaaaacagatggaagcacatgcaagtggcttgttgacatttactgtttgacaagaccctctgagtcatgtggggaatgaactgtacagaagcaaaagttcctgaagtttagggtggggctcaccagttgtccaggcattagatgatgatggtttgacctgaagaggtgagagctgtacatacggagagaagggaagagatctggggtagggttggaatgcaaaaccaacagcacttagcaattgactagacacatggagtgaaggagacaggtagatggaggtgccttattaagacataggaaacatcgagagcagcagtgtggtaagatcagcatttggacttttttttagctttgcaatctctttgaaatatccaagaagacataccactggtgctcagaaattaggtctgaactgggttcatgagcgtgttaacatataggtcataattaattcaaagattgtggatgggattgcttagggaaggagtataaagcaagggtcctcggctacaacttggggaattattttgcccctcaggggatatctgacaatgtcttcagacatttttagttgacacaattgggggcatctagtgaagaaaggccagggaagctgctaaacatcctatatactcagaccagcccccacagccaagattacccagaccaaaatgtcagtagtgccaaggctgagaagccctagtagagactgcaaatgaaacgcgagcttttaggaacttcacctgaagtcttcctccctcctccttccctggctactctgactccctcttaatcagtagtcagctccctcccctgtaaggaaagggcctgagaaatagagaaatctagaaaagtgatcaaggttggagtttaatgagaagtgctgcaaaattccatctgtgtgtccataagatatacctattttgtggcctgttgaaaaataacaggtttatgaatattttaggagaatttataaaaaatattttccatacaaactaaactctgaaccagcatatacaatactcccttttgcaataccagcacttggcactgtttgttgctcatgttcctgaagagcagagacggaggaggagcaaacaaaacagggaggaacaccaggggagacgggtgtcaggaacaccaagaaaacagagttttcaaagaaaaaaatgagcaacaaacagtgctagggaagtaggaggcggggaatttgggtaggaaaaaaaaggatgaatcactttacatagaaaaaagcaagccccacctacaaatatgtttccaaatgaccatttagagtttgctatttggattttataagcagcttgctccagaaacaatgttataagaagtagttaagtttaaggaagaagtagttaagtttaaggaaaaactacaaaaaccggtttaacctgtatctgttgatgttacagaccaagttatagaaggccatgagtttgggaagttcagaaggattttttttttgttttaatcagctgcctttctctttctcttgggaatacccttggccccaatttttttaaagctcatttgttcatcaaatatttattgaatacttacataggcatttgtttagtgtctgtgtccccactaaattctaagctccatgagggcaagtgcaggtttactctgtgcatttctgaatgctaccactaccgccattagtgcctggcagccagaaaataatcattgattaacagctgaatattgatcaaacgaacaaatatattgctaaaaaacgttgtttgcttactctaatgtatttcaaaagggtggatttctatgcagagttgccataaaaactttttaaaaagtagcctagtagtgtagagaacgatgttttgaatcagaaaggtgatccataaataggccagttttgcctgagagcctacccttgaattcagccttactcaaatagcatatatatatttatagttctatatttcttcctctctttgggatattaaaatctttctatttttaccatggctgtggtagtggtgatgcaagcatagcccaagctaacagttttaaagtttagaaagaaaccagcctatttcctttaataataagaggaaatcttcaggagacggaagtttttgaaatggatggaaacctactaacaggattaatatattatcgtaaacaattttatgcaaagaaacttccacattgaacttcaaaggggaaaggaatcgagacaggaaaaatgggtcaagtggagaggccttttctgattagaagatagtaagtggggagtcttttacaggccctgactgaagcatgaggcctttgcaacgtgcctgtcttattgctaaacagtgcgacttagactaaataatactaaaaagcgaaagtggcctctctgcaacaaaaacaggcaggaagcagtaagaactgggcaccccctatgaagccacggcattaaggcgtcaattaaagaagacgacagataaaaaactgcaaacatacactttaatgagccagtaaatgtgcaggggtccaggacttttaaatattcgaggtcctaaataaagatccgtctcaaaacaaaaaagaaaagagtaagatcctgattaaacaacaaataagacttagtcaatagcccacttaattttactctgaagtttttaagtgttgccttaagtttgtaatcagcaatacataggtatattaataacttaatattaattaaagttcaatgtgtattttaataattatacacatacatattcaaaaacatagcattaaaaagttctctgtcacacttaacaatccacatctagagatccatggttgatctagaaagctgcaagcacaaatgttcataactggaaacttactaagtttataatcaaacttaataatgaatgtttaggccaggcacagtggctcacacatgtaatcctagcactttgggaggccaaggtgggcgagctgcttgagcccagagtttgagatcagcgtgagcaacatggtgggaccccacctccacaaacaaacaaaaaaaaacattagccaggtgtggtggcatgcacctgtagtcccagctacttgggaggctgagatgggaggatcacctgagcccagcaagtcaaggctgcagtgagccatgattgcaccactgtactccagcctgagcaagagtgagacgctgtctcaaaaaaataaataaataaaaataatgaaagtttaaacttaataattaaaaatgagtgaacaattattgaatgcacattctaatactaaaggctttacatgtatttcatctagccctcacaacatatctataataaaggtagggattataattggacccatcttagagatgaagaaaaagaaggaataaggaggttaagttaccaagactacagcttcagagctagaatctgaactacatatttgttttaaagttctgtaatgtaatgacaaacataacaataaggaattcaagagttttttggaagtgcagtaaacttttcactgcttattttgatttcctgtttctattttcttctctcaatactccttgttctcatcttctgcgtctacaccttctacttgaacaacaccatccatttctacagctttaggttcacgtctaagttgaagatccagcctagacagccccctctcagtcaccaccaagtagacatcttgatttggatgtcattctgctacctgaagctaaacatgaccaacactgaactcagtacctccaacccagacccaaagtctacttttctttgtatgtttcttacctcagaaaataaccctatctttctgtcagtgcctacaccaggaacctgggagtgaccattctcctttaagccctatagacaatcacattacaagttctcttagttctacctcctgagtaactcacccgttagctgagtcttctcatctacacctccaccgtcaacttcagcgggactattgcaacaatctcctaacagtcctgcttgaggccacattccaaatgtttcccgcagtgctgccaaagtgatttttctaaagaataaatcatgcagtttactcatttatttattcagcaatttttttgttgaataccttctgtgtgccaggtactattctaagtagccagaaatataccagttaacaaaagagacagaaagggcatcaaaggacttatgttctagaggagagatactgacagtaaacaaaatgagtataaacacatgtgtgtgtatagatgtgtgatgtgtgggtgtgcatatgaatggtaataaaagcttactgccctaatgcctaatctcactagtcccccattcacccacaccctagaattcatccctattgagctacttttactttcccaagcatgccatgcccctatattcaggcctgtgtacattctcctccttctacttaaagttctcttcccactggcttttcaccaggctaacacctaccctctcccggccagttttccctgatccccccagttcttattttgctctccatcatgaggctcccaaagcaactaaaccttccccagagagtagataacacatactccgattatgtgataggtatttgtatgagtttgctctggttgccataacaaattaccacagactggtggcttaaaccacagaaatttattttctcacagttctggatgctataagcctaagatcaagggattggcaggcaggggtggtttcctctgaggcctcttttcttggtgtgcagatgaatgccttctcaatatgtcctcatatggtctttcctctttacacggatgtttctggtgtctctttgtgtgtccaaatttcctcttctcatgaggataacagaccaaattagagaataccctaaaggcttcatttttaacttaagcacctctttaaagaccctgtcttcaaatacagtcacattctgaggtactgggggttagtttaacatgaattttgggagcaggggcagggggcacaagtcagtccctaataatattctataatcgattcattaccaatcttttttttgcctgtggccctaaaaaactccccattcccatattattttgaagaaaatgcaagataccatatccttcaatcagtaaatactccttcaacatctttagataaagaaaatatattttactctctgggactaaagagatgaaatctacttaagctctctgattactctctaacaccttttctggttttaggacattttctaaaaagattctgcctttttggaaaatattttccctcataataatcactaacaaaacaaatgttttaaaccttcaatatggtagatcttcagtctacactccaaagatggaaaaggaggtatctatgagggggttttagttgaggtttaatttttctacatgcttcttaggctactggaaaagaaacattgtgtgtgtgtgtgtgtgtgtgtgtgtgtgtgtgtgtgtgtgtgtgtgagatattattactaaaatgggactaacggattttcaaggttcattttgagaatccacacaagccactccatgcatcatcagtgagacctaagaagccaggctattttctcttttcattatggatgccctttacacatctcctcacctcctaacagctgtcatggcaacattctcctctgtcagatgagaaagcagcaagactcatcctcttaatgcatgaatgaaccacagaggcttctgaataacagaattccccagagtttggatgacactattgcaaaatgcagttttgcagtttctgccagacagtctgctttcaaagtaatgccttctccatactgacacttcacactgtgatgacaaaatgaggaggagatgaaagagatggttcttctttactttccatttgtgactctatgtattttgtccttaaatagcaggttgtaaaaagacaatgaataacatgggtgctgaagaatatatggactatataagattctaacaactaaaggacactgttgttcttgcatatatttataaggagaaatcaaagaattgctgtattccagaaataaactgagtagcatgaataccaaaagttttattcagcagaaattattgaaactggaaaaaatggttcggctaataattctacaaatgaacacatgagtaggtatacttacattgatttttctaaaataaaatgtatttcagcagttttagatttatagaaaaattacaaaaattgcaaaaattacaaatattacagtttcacctatttgtttcatcgctccacttatatcaacccagagagtttcccctattactacacgttctaagtgcacatttgctacaactaaaggaccaatattgatacatcattattaactaaagtccatactttattcaattgtcttcattttacctaatattattttctgttctaggaccccatccaagaaaacatatttcattagctgtcatgtttccttacggtcctcttggctctaacaatttctgagatttccgttggttttaatgaccttaacagatttgaggagtatttatctttgtaaaatgccatcaattaaaatttgtctgacgtttttctcattatgagactggagttatgtattttgggaaggaagaccacagaggtgaagtgttatctttatcacatcatacataatagcaatagtgcttatcactgctgatgtcttgatcatctggctgtgagtaactaccataaagtcgcttccttgccctttccacactatactctgaaacaaagtcactatgcataacctacactttaaggagtggaaaattaccactttcttgagagtgaagtatctgcatcaattgtttggaattctgtaggagatactgcttcttctcctccatttatttattttttgtatagatacaccacaatttgtttattcatttacctattgaaagatatttttgttgtttcattgtttcttcttttctaatgtaagcatttagtggtatcagttgttctctaagcattgctttccttgcatcccacaattttttgtgtttgtttttgttttattttgcttttaattgacaaataataactgtacacatttatgtggtacagtgtgatgttttgatacatgtatacattgtgtaacaataaaaccagggtaattagcatatctatcacctcaaatatgtgtcatttctttctagctacttcaaaatatatgcaacatgttattgttaactctagtcaccatactatgcaatagaacattagaacttattttaggtgaagttttaaatactaaaattattttacgaaaataagcacagccatttaagtatgttattcacagttgtactgctactgctagtatatggcaagacaggagttaaactcacaattttttataagttatattttaaattttattttattcaaaaaatttttcaagtgcctgggtctcactatgttgttcaggctagactcaaactcctgggctcaagaaatcctcctgcctcagcctcccaagtagctgagactacaggctattcaaaatactcttaaatttatcttgtgacctcttcagtcatgtgttattgtgaagggtgctgtttaatctgtaaatattttggcattttccaaatatctttctgttattgacttatagtttaatttcactgcagtctgagtacatactttgtataatttctattctttaaaatttgttaaggtatgttttatggcccaggatgtgatctatcttggtgaatttccatgcaagcttgaaaatgtggattctgctattgttggatggagtgttttatacatgtcaattagatcaagctgactgataatgctattcaagtcaactacgtccttactgattttctgctggcttgatctatcaactagtgaaagaggggtgttgaagtccacagctacaatagtcaatttgttattttgaaattgtgcctctttgcaagttcatcagtttttgcctcatgtattctgattctctgttgtttggtgcatatgtttttatgattatgtcttcctggagaactgatacttttatcagtcttaatgtccctatttatccctgataatttcccttgtactgaagtctgctttgtctaaaattaagatagtgactccagctttcttttgattggtgttaacatactgtataattctccatccctttactcttaacttgatgctttatatttaaagtgggcttcttgtagacaataaggatttgcctacgactctaggtttcctatgttttatatatttttttcttattttgccttctcttgctttaattctcccctcttgttcttctttctcccgttttaattgagcgttttatataacatgttatctactctctgagcatctcaattatatttcttttaacttttttagtggtggttctagagtttgcaatatgcattttaaactaatctaagttcagtttcaactaatactatgccatttcatgtgtagttcagataacttaaagtatttccaattcctccctccaatctcttatgacattgttgtcattcatttcacttaaccatatgctataattatctaatacaccgttacaattattagtttaaacaaagttttcttttagctcaattaatgagaaaagcaaaagattttactttaccttaaatttattccttctctgatgttctttccttaatgttgatctaagttgctgaactatcattattcttttctctgaagaacttcttttaacattttataaagaataggtatgctgtgctaataataaatcccctcggttttgcttatgtgagaaagtctttatttctccttcacatgtgaaggataatttttatggatttagaattcaaagttgatgagggtttatttttctttcaactctttaagtatttttcttcacttgcatagtttatgatgagaagtccactgtaattcttattcttgtttctctatagatatggtgatccccacaaccccagggcttctttcaagattttttcacattccgaagttgaatgtcatatatctaagtatagactttgtggaatttattctactttgtgttctctgagcttcctggatctgaatttaggttagatgtctgtcattaattttggaaaattatcagtcattattacttcaaatatttctcttgttccattcttatttctccttctgatcttccaattacctgtatatgtatgtttcaccttttgaaattgtgccaaagttctgagttcttgcatcttctgttgtttgtttggttggtttttgagacacagtctcactctatcaagcagccagagtgcagttaatagctaactgcagcctccacctcccagggtcaagtgatcctcccaatcctcccaccttagccttttaccatctcaagtagctgggaccacgggcatatgccaccacgcctggctaattttttttatttttttagaaacagggtctcactatgttgcccaggctggtctggaactcttgggctcaagcaatcctcctgcctcggcctcccaaagtgctgggatcacaggtgtgagccaccatgcctggctcttttttttcccattcttttatttttgcatttcagtttgggaagtttctattgacctatcttcaagattactgagacttttaaaaatcgtgttaagtcttctgagtgacccttcagaggcattcttcatttctgttactgtgtttctaatgtctagcttttccttttgatcttttcttagctctttcatcgctccacttacatcacccctctgttcttgcatgttatctactttttctattagagcccttaacatatgaatcatagctaccgaaattccctgtgtgataattccaaaatctgcgtcacatctgagtctggttctgacgcttgctttgtatctacaggctgtttttccttgcctgttagcatgctttgttgagacagggtcttacttactctgttgcccaagctggaatgcaatgatgtgatcacagcttactgcagtcttgacctcctgggctcaagtgatcctcccacctcagcctcctaagtagctgggactacagccatgcaccaccatgccaggctaatcttcttattttttgtatagatggggttttaccatgttgcccaggatgctcttgaacttctagcctcaagtcatctgtccaccttggcttcccaaagtgctagaattataggcatgagccatgtgcccagcctcatctgtgtaattttctgttgaaagctagacatgatgtatcagataacaggaaatgaggcaaaaaggacttcagcttgaggcttatctgtctaagattgggttgtatataatgtttgctataaatgtggttgtcagaggtttcaaagtcctctagtgtcttttttttttttttttttcatctctcctgttgtctttggactttcctgagaccccctctccttggccagccagtgtctgtctgcatcttgcagctctttcagctgtaatccactgttattataaggagccctgttgctgtggtggtaaggagtggggaagggaaacattccattttcttaggattacatctcaatcttttggtgggcctatgttgctgtactgtgacctttacaaatgtttcttaacctttttcctccttccttagttgacacaggaatctagaggtgcctcgagtcagagaactatcttctccccagatgggataagactctggtaaagcccttttccttggagagtaagtctttatcatagagaacattctgagcgcacttcaaagtcattactttccccttccctttgccagagccaggacagggtctatcttggctctttgctgtgaaaacctgacgggtttccgggaggtaaaatccatgtacgtgtgagaccctttctcagactcctgcgcctaggagttccactctcaagctagtcaacacttagcctccagcaattcatcaaaattactatttaaatggcccttctagtctatggttccagttgcttctgctgtaggtaagcaaatcttagctgtgactgtctgaatgtacctatttcttcagattttggggtggcaagtgatttgccctgagattgctgacagttccaggaaaacttaccaagttttacttgctcaggtttggaagggagtgaggactcccaagcactttacatgctggagtgccttactttgtttttttcatattcctattttcaatacttactttatagaaacagaaatgtttgcttagaaaagtatttattgagaattcatggcaaacttaaggagaataatagcatgcttgggaagagaaaaattgattcactcattcaataaatatttgttgagcacctattatggtgctaagacacttgctggatagcaactggatagtaaggtatggtgaaaaagacagctatagtccctgcccttgaggaacttatattctagtgagggagacagaaaaaggatatatgcatgaaaatagtaatcacagtctttaagaagctcatcaaagggataagacaaaatataatcatcacagagagtataaatgtctgagtgcattgtaacaaggtagtttagcaaagagaagagatggtatgggtttgaatattctgagacctgaggagaagttagaaaataagtagaattaagtttgtgaagaaatgtcactttgataaagggcaaagcaatagcaaagacgcagaggcaggaatcagaataacgtatttcaatatagccagttcagcttggctgcagtgtagttttcactgcagaagagtgggagagaataagtggaaaagctggtgaatgccagaagcggaaatgtgttgctcaacaagaaccgcgaggaccttgttgttaaaacattagccaatgggtggaatgggaaaagtactaagctaggattcatgaggacagctagcatttgccattaaccagttgtgggtctttgggcaaaactgtctgactctgagtctgtgtcttcatctgcagtaaaagaaacattgaattgctgagtcttcttcccacttaaacaccctaaggttctgggtaggaaactcttctacatcactccaaaaagtaggaatctagtctctgtctgagtacttcaaatgacagaaagcttactattctttgaggcagccagttcaacagctctggcactgaacagttaaaattaatagaacagttttgttagaaatgagctgaaatctgccttgccataattcactctgttgaaagttcaaaacttcagagcagctctgcccaacagaacttcttacaaagatataacagtccaattcagcagccatgtgaccactgagcacttgaaatgtgcctactatgagtggaaagctgaattttttattttatttaattttcatttaaatagtcacatgtgaccagtggctacagtggtggaccacctagctctaaaacaaccccaaataaacttcttccttccacataacagctcttcagatatgtgtgacagttcattaacgacctgtcctcaagcttttctttttctagctcatcacagtgaaatgctctaactattgttcatatggtatattttgcagccccatgttcttactaatgcattctaattcatgcacactcagctaaggtccaaagatgctttccagaaaccatgaaacccctaaacttacatgcaaatctgttgtgtatttgcacattatttagaggagagcttttagggccgccttcacattctcaaaggaactcctggcccccaaacagggtccggggtgaaaagagaagatgaaagaaaaatgggatacaatggcagtattaatgatagccctgaaatgtaacataacaaatgagaggctgagatgaaagcagaccttaggaaccctagtgcctaggcttgtttctatttcaacaccacctgtgtattttcacacaagagttgcttcaatgtctttttaaaacacagccaccatttttttctataaacacagtaacatgtaatttttataaatctatatgtcatgtaaaactgttattttttcagtagaaccattgttgaaaagtattttttaaatattaaaaacactccttaatacaaacaaaaaaaacccacattatgtaggttattcaggggtttggggtaggtttttttctttaacttttttctcttttgacaggaaaatggttattttttcccttttttcctttttcattcttttttttttttttttttgaaggaaaatgtacttcaaaacccctctttcagcctgttaaaaccatttgtaattcccctggttcagatcctaccgcctccatataggagagtgtattttgaaaagatctttgaattctgaataaattcatcttactaaatcaaaagacctatgtatatcaaaaaatctgacctctattggcttaaatcaaagcatcacaactctgccagtatttatcctatttttaaagaactctaggaaagataattctgttacctcaaatggtaattcattccaatgccatccagtaaaagaccacatataacatgaccctaaagtaattttgtaggtaccatattgcctttaccaagagtacatatcaggtacaagtgcatcagctatgtgatggttgtagcttctctttactaccatcctaatgtaatccaggcattaaaattatataagaagacccttcagcatattgaatattgaactctagagttttcctagaatacacagttagaaggcttttcttttcttttcttttttttttttttttttgagtcagagtctcactttgtcgcccagactggagtagtgtaatggcgtgatctcggctcactgcaacctccgcctccctggttcaagccattctgcctgccctagcctcctgagtaggtggggattacaggcgcctgccaacacgcccaactaatttttgtatttttagtagagatggggtttctcatgttggccaggctggtcttgaactcctgacctcaggtgatcctcccacctcagcctcccaaagtgctgggattacaggcatgagccaccgcacctggcctggtctttacttaagtattaccttctctgtgaaatgatccatctaaaatctcaacccccactccatacacatacatatttcttacctccttgcttgctatcttgtttctccttagtacttatacccatccaacatgcgataacagacttatttatcttatttgttaacttatttattgagtatcttgtccaactagaatataagcttcatgaaggcaggaatttcaacatctagaacactgcctagcattcactatgtagttgttgtataaactgcataaatccatataaaagttgaagtgaaaagatgaagtaaaaatgaacataattttgacattgtctaaactaaaattcccatttaaacacggatattgttctctggaatttttaaataagatataaaaataaaacgctcattataaaaagtcaaaatgaagttcttagcaaggtgtctggtgtacagtaagcgttcaacaaatgtttgctattattgatttttactgcacattttccttatgataaattcttagaagtatccaggtcatagacagaggcacatatattaagtgcctaattaagtgtaattttcagggtccctcatttcctaaagcttcttccaagacgtaaaagggatcctcgaaatgtgttcaatggctctgcttttgtaaaatttgtaaaaataaaatatttcaactggatctgttatgactgctgttgccatccactgcaattttcctctcatcaaacattcctttaaattgactgcactgaaggagacatggacatttttggaatctggggggtcaaactgactttggaattatactttattttggtttagtggcttttttatatggatttggggtcacctccagggataggtattgatagctgttccagactagaaaaaaaggcaggaatattcctactgcccctcattccatctcaccctgcaaggtcagaggtcacatcacaatgaaaacacctcttgccaagcctggcaccagaaatatatgagtagtgaaggagaaacagcatgtaaaatgtatagagccacaagctagtctgtagaaaattcttccaatcatcaggtatctaaaattgtaaacaaaggattcagtttccatcagtggctagactaaacgaaggctctctcctgtcagaaacatattcaataatgcagtatatgcaattacaaatgcaacaaacctgtggcagtgctacaaatagcaaatttgtgtgcgtgagaattttcaggttttatgcaactattaacaataaaaaatagatttccacctaccatgatagaggacttatctttcctgtctttttgtagaaaatagtacaaaaccatcgtcacatgaaaaggcaatcaaagagtaaccaaaataatataataaataaaatagaggagtgtcagaaagtcaattactaaaaaatgttaaaaacataatacatgcattctgttcaagggcaaaatacagagaccagttaggagagtgttcccatgatccaagagagacacgatggaggtttggaccaaggcactagcagcagaggtgacaagaagttgcaaatgtgttttggtctgtagtagtcaatggacacagatgaatgatacattctgaggcagtcagagcacagctgttaagagccatgccctggagccagactgattcccaagtttgcctcatagagatggattttgtgatgtttatggtatttaccaatttcataaaaatttgttgtgattttttctcattcgaactaaatatttaatgtcatacctaaatttgtatttataactttgggatccttttttaaaagaactctctcccttccccagttgcataggcttgggctccacaaaccctgtatctgcctttggtcacagagtatgtagattttaaattttgacatgcatcgcttaatttcccattggaaagattatgcccattgccactcctgatttccttaaaacttaaccaacattggctattatcagtttttctcaatttggccaatttgataggtgaaattttaatttgtgatcctttgattaccagtgatactgaacatattttcatgtatgtattggtgatttatatatcgctcctcacagactgtccaatccagtcctttgtcatttttctgttagaaagctggtctttattatttggctggcatacaaacaaatgcaaaatgtatcaaatattgttactgttactgtgtgtgtatttacaccacttatcttgtacatatattttcatttgaacatttcacctccaaatgccttgtttctccaactaaagggtaggttcatgcatgacaagaaatgtgacatgtatatcatatcatatcatatcacctggcaaagaacaaaagtattttaaatgagtgatatttaaagcaaaatctacactccttatgctactaccactaccactacttctacagtgtgaacagctgagtccattcaaccaacaattgaagctaaatacaaaggttgagtaagtatgatgtgtctggccaaaagagtatttcatcatcttgcttctgaatgactatctgaagacttctgccttctaatgtcattatttctacttatctctactcttccaaactcttctttactgccttaatattctctgtctctcttttttgtccaatcctcagattcctaaaactcacatacacacatccaagtttataaactgccaagctaatgagaaatttgagaaacgaattctatgttctgaactgaatataaattgtagctaattctggtccccgctgaggcctttgaacacacttatatgattgaaaatacaatttcggaaacagaagcaggttgctaattacaaggaacatcaatggatagctcccagagaaagattcatcaattttggtgtaattatgaaagtatatatataaacattagcattcccaaatctgccatgattaagattaggtcaaactttttttttttttgtcaaatcattttctgcatttcttttttttctttttttttattattattatactttaagttttagggtacaggtgcaggtcaaactttcaaaaagacacatcataagctctagaactgactataaatttacatttctttaggataaaatttttctaaagaatgcacattaagttctataacataactctttaacttcttttaaaatgtaacataaaggttacagaaaagtgtacaaatgattaggtgaagagtatgatgaacacaaaatgaacacactcaagttatcagtccctagattaggaactggcacactaccagaagctggcagaccccatggtgccccttctcagtgtttacctctccctgaggtacaccacaattctgactttcaacaccatagattagttttgcccatttttaagtttatataaatgggaatcaaacaatacatacttttttgtatctggcttgtttttctcattgttatgttgttgcacgtaagaataatagccaatgtaagatataacacccaagttttatgtcactaaagaatgtcttctttttattactatagtcagttctagagctgagcatttttttttttttttttttttttttttttggctcttgctctttcatccagtttggagtacagtggcacaatcatacctctctacagccttgaactcctaggctcaggtgatcctcccaccccagcttcccaagtggctaagactacacgtgcacactaccataactggctaagtttttttttatttttattttttgtagagatggagtctcactatgttgcccagagtggtctcaaactcttgagctcaagcaaagctcccaccttggccttccaaagtgcttggattacagatctgaaccacgacacctggccctgggctctacttttcataaagtttcacattttagactttaaatccaaacccagaaactatctcaacaagagttaataaatagactcaactctgggaatttttaagattactttttgatacgtaaagtgcatagtcacacatagaagcaaggaattttttttattatactaaaaaataactaaaaagcactattccctaacatttttgaaactttgacttaaaagcacttctacagagatcaactgtaagtggtctgaatcataaaccaaaatgaaaagcacatacatcaaattgaaagcatgtaactttgatttacctatttttgaccatataatttgaaatgaccactctctctccctgctcagcctttgtcttaagtaattatgttaacatctcaagtctccttcaaactgtcaatatttttcccaaggaggaaatgctactgcatagctgatgatgcccaggcatcaggcttctgcattcctttctttcattggtctcagattagctgtcttctttttgtcctaaacattaaaagttactagatttcagccaaaaaaagaagtattggcgtcaaaagctaagacaaaaagtagataaaaataactaatggaaaacaaacaaacaaaaaactattttaaaaaatgctccatttccaccagattggtcattttccttttgtgcaatgacatttcattttctttcacttgatctgacttctaaccaagttctttcttaaattacaggcagctaagcctttaaaatttttatctgcagctttcaggatccacagagacaaatggcaaagtggtagaccgtgacacagccacaacccaagcccacagaggccagccaagctttatgcctccagcagcatgcctcagtctctgtgctaggtcagtagctccacaccatctgggttcctcccccaggatatatgatttactaaacctgctgagatcccatgtgtgacctttttgaagaattaaacagaaaatacactttttttcctgtatagcaataaatcccaagcattttgatccccatgaccccacttgaggatttatataatatccccaagccacaaaacttctcttcttaaaaaaaaaaaaaaaaaaaaaaaaaaaaaaaacaagcccgtcatcctgcaagtaccattaccactagataattctgaaattacttttcctcttatatgaattcacacattttggcaaggtgaaaaaaaaaaacaactcaatgagtgaatgcaggagtgaaaatgagttggcttccctagtttatatggtaatagcccatatgagccaccatgaaaaagttagagcactacagctgctgtcttcacgaacccgtcaaaacacctctcaacccctctgagggctccaagcctcagggttttgttgttgttgttattcatattatggccatgaacccacattgaacaaacctcagttctgagagacactatgttatgggttaagttgtaacccccagaaagacgcatacctgtatctatgatgtgaatgtgactttatttggaaatagagtctttgcagatgtaatcaagttaagatgaagtcattagtaagccctaatccaacatgacaggtgtccttaaaaaaggaaaatgacatacgaaaagacacacagggagaatgccatgtgatgagaggcagaaactgcagtgattcagctgcaagccaaggaccaccaggggtggatggccaaccttagaagctaggaagaggcaagggaggactctgctaagagtctcagagggaacctggccctgctgtcaccttgattttggacttctaacctccagaactgaaggagaagaaatgtctgttgttctaggccacccagtttgtatagccctaggaagcaaatacacactacaatgattatgttaggagaatgccagtgaggcttctgcagcacccctctttcataagacttcagacagccagaacagaagactcacaatctggtaccacgcactaagtctgtttaattctcagttacctatgaggacatgaaatgctacaaacagttcatctctctgcctctgaaaaagtattttgtacttctatttgaatgtgagtgactagcattctggaaatttactacacttcaaacagcaatgacagcttacacatattcagagctcaccactcaccagatgctcttttaagaattcatatatgtggctaggcgtggtggttcacacctgtaatcccagcaccttgggaggctgaggcgggtgagttacaaggtcaagagatcgagaccatcctggccaacatggtgaaaccctgtccctactaaaaatacaaaaattagctgggcgtggtggcacacgtctgtagtcccagctacttgggaggctgaggcaggagaatcgcttgaactcaggaggcagaggttgcagtgagccaaggtcacaccactgcacttcagcctggcaacagagcgagactccgtctcaaaagaaaagaatatgtattacctcatttaattcttacaacaactctgtgaaataaaatattatccttattatataaatgagaaaattgagacaagaagaaactaacttggccaagcatcagaaccacagtttgatgaccccaggcagactgattccagagccagcttcttcaccagcatgcaatagtgtctctattacaaatccacactggatgtagtttcgattattcagtttattcatgttactgtgtctactcagcatctttcatcttcctctgctcttgtgacttgttctccatttccgtgttttgagcattggccaaattaccactagacaactaaaggacccatgtttaacatagctgaatcccttctgcaaatgtgctgtttcctacttttcctagggcagagaggttaagtattttgatttaaaaggccttctattccaattgaattatagtaatcgaagctcctatttatgttaaccaagcacttaagcaaagaaggtgacaatgtcagcaagtctctttcaagagcttaatgtgcataatctctaatcaggagttggccatgcagtagagcaatcttccttatgatctacaagctggaagtgatccattcctctctcgaattctccttaatacttaatgcttattatgactttttaaagaactaccttcttataattatttgtgttcattgttacttctcttttctcattgtaaattccttaatttcaaaactacatttttacatctgtctccctcagagcaacttccttggttccttgcataaagcaagtgctcaaaatatatttttgaaagaataactggacaaatataaatgactataatattaaacaactgatcctgttgtaataatacactgaattctaaagatagattattcagtgtaatcaaagtgacataaaggaatttcacctaaagaataagttcctatgtattaccaaaactgtaacttagactttaggttgaaaagcagaaaagaaaaaatttagctttacagcaaggttctgatatacgtttatctaacccaaagacagtttataaagataaagcctctacttaaaaggataaacaaaaactacaatttttcaaaaataaaggaagtcacactgttcaattggtgtaggtattccaacagcacagttgcaggaggactcagctttgctgtacatgagtccttcacatttgcctacatggtgagacagcctactggaaaagaaagtagtttctaaatgagaaagcaaaatgcctaaatgttaggcttctacactctcaattttagaattaatatgtctgggctacattgtgttacactgagaaaaatcactgctgttacctttgaggaaactgaattctagttgcagctccactacatagtaatgggagagccacctttcattgagaacttataaagaacactgttatactatcttacctcatttaatttggatagtaactctgtgactttgttgagaaaacagaaggtcaaagatgttaattaactcatttaataggtagcagatctagcactgaaatccagttatttctgtctccaaactttgtactctgcattcactctctgagatagcaatggctaacagcatacccaatatccaatgtctccttcttgattttgtgtgtgatgggaacataaaatcattcaccttcctagactcctgtggtaggcaacttctaggatggctcttaatgttccccacctcctgatattcatgtccttatatattcccctccagttgagcattagctggacctagtgacacctataacaaatagaacagggcaaaagtgttgtaactttgcttccaagcttaggctgaaataaactggcttccatttattctgctctctctcattctgttgctcagtgggagggaaatcatctaccatgttatgatctgccctgtggaagaggccctcatggtaagaaatggggaactttacccaacagcaagtgagaaactgcagctttcagtccaacaacgctttagaaattgaattcttccaacaacagcatgagtgagcttagaagtgggttcacccccagtcaagtcttcaaatgaaactacagccccaactgatgccccgattgtagtcttgtgagagaccttgagacacaggcacccagctaagctgttactggatttctgacctgcaggaacttttaaataataaatattggtggttttcagctgctaaggaaggataataggttatgcaacaattcctaacacaacttcctttgaagtttgtaggggccatatgacttataagatgtaagcagaagtttaatgaatatggctactagaaaagctacagttttcttgataaaaaggaacaaaatcagctttcattagcttctggcacttttccctccacctttttccttcctgaaatgtagatgtcatgcctgaagttacagccatcatcttatatccatgagcacaaaacctatatgaacttgggtcccttatggcattacggcagtgccaccgcaacactggactgcctttctcttgacattttgttacaaaagaaaaagaaacattctttgagtcctgttatttatagccaagtggaattctaactaatttactccttttccagctttggctggagcagttttctctataaattaataaattaataacaaaaactataattttcctactcagctgtgttgaagtgctctgttcttataaaatgccatgtaaatataaggtattgttattattattttaagaaatcaaaatattattaacatttaatgacaagaccagttgtaatcttactgacaatgaatggacatgtttaagtaattttaactcttagcaatatttttttaaaaaacccaatttactagtaagttttcttcactaaaataaagtactttaggtaattattttaataactgcatcttgataaagcttttttatttactgtaacttaataataaaaccaacataaagttttaaatattttccctgtgttttatacatatttgatagagttgtatctatgttttcgaaataattcagaaaacacctgaaattaa

SEQ ID NO: 67 - DNA, 30786 bp, Homo sapiens
ctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagttatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagtttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtttagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattactactggaaactcatttttacataatatagtccttaaattatttaacccttgctaagtaattgacatatgtaacaataactagcctaaagaaacccaaaaaagtatctctcccgagctgaaacttaaaaattcgtaagtgtaagaaagaatgtgagaatatattaaatgcacactgtaccattagatgaaatcttacttgagaaattgccataagccatattacagatcttactttgttactgaatcagattaatttcttgttataataattttcatcataaattttctatttttaaagccgctggtactagaaatattcttttaatgctatatctatgtacctactgacacatttttctccataaaagtacttttaaaaattacttcatgatttgaaagctgtttcctgctattatttcattacttactttgttggtgctattggctttttctacttatttttacaagaaacctggagattctggcttacttaagtcatcagaaattctctgtatctagattgcatcatctcatagaaacacacttcacaaaagagatgaatagatacaactctggttccttcattatagttgccagattaatataagctgctctagagtgtgtaggggataggagtggcaggtggagcagaaatgaatcacttctcaaaggaaggtgacttttaaactcagaactgaagaattaaagacttagctcagaaatgattgcttgtagagagagaataacagcatgtacagaggccagaagagaaagcatccccacactggataagccaaaagagatttagggtggctggaagatagagcacaagaagagggagtggtagagagatggtggttaatgaagggccttgtaaaacatgacatgccacttaaactttattcctaaaggaaatgggaaccaatggaaaactttcaatctggaagaataacacgattagatttacattttatgaggatcaaatagcatacttcagttgtcccttgttatatgtgggggattggttctaggacctcctcagctataaaaatcttcacatattcaattcccacagtcaaccctatggaacctgcagatacaaaaagttggccctctctatacaagggttacgcatcccacaaatactatattttcatctgcatttggttgcggatgcagaacctgccaatgcagagccaactaaatttactgaaaaactccacatataagtggacccatggagttcgaacccatgttgttcaagggtcagctgtattttgaatggtttaaaactattgttttggactgagttcctgcacctaggccccagtagaccagaccaaagcaaaatggagtcactcatactaaatgccacacaatcaaactgaaactttaaggaaataggtagatccccagactagtttttcctcaaaacaggagattccactctatctgagcataatcaaggaagtcccctctgctttaaactgtacaaagaagatgtaatctgaagtaacctaatgataaccaatcagtttttatttttctattattctttgttcccatccttacaaaacccactgttctgccattacccagtgggaacttcattctattttgtagaatgaaagttacctgatacatgaatctagaataaaagccaattagatctgtaactaatttgttgttaattttgtcttttgacagaacggcagagcaagatttagacatagggagtgcttggtgatattgactggaatagattgtggaccacagggacatgtacagagttatggtttaagatagatagagttggtatgggggtaagaaagataataagggtggctcccagatttctgatttagacagctgtcaatatcattcactgagatagggtatatcagaggagttgattttggatgtgttaagagagtgaagagatgaattcagattagagcaaagtgagattaaggggcttgagacaaccaaatgtatttcaatgtaggtatggaactcagaaaagtgataggggctacaagtatggatttgggagtcaacagcaaatagttggaagtctactttgagtatcaagctttccttttctcaaaaactgtgtgtcatagtattggcttctggtacattggacaatgagccctttttgcttgctaacactgctgcattctgtatctattatttatcctggacatctcgccatatcactacacagaaaaattccttattcttggctgggtgtggtggttcacgctgcaatcccagcactttgggaggccgaggagggtggatctcttaagctcaggagttcgagaccagcctgggtaacatggctctcagtattaaggtacttctacctatttctttttgcatgtcttgtaatttatgctttatgaaagttgttacttggtgtggtattgtaactattataaagtccttatgaattatagtatttagaattacaaagtgcacttttttgtcttatgttttctggcttgaattctgccttgttttattaagatcatgactcatgctttctttttatttgtatttcctggcatgcctttaaccatccttttatttttaacctttaacctatgttttaagtatctcttctgtacaacaacaatatagcattggatttagcctgaaatcaaatccaatgctatattatatgaacacctttttgataggtgagataagcccatttatatttattcatgtgactgtaaggacttaattcttcatattatttgctcttttcttaaaaactcattattttaattacaacatttaagaaagtgtgtatctttgattcagtggctatagttatactatctttggaccccatttctttatagtatctgcttctcatctataaattaaaaatttagcttgtacatattcttatttcccactacccaatttaaggcaatattatcctttactcttgtaaattgtactattaaatattcttaaacttctactacttgtcacttttaaactgtatcttttgaattctaactatacaaagcaaagagcttattctgtgttctaccatttctcctcttctcattttttgttagatgcattatttttatcagagtataaaacatttagatagtattgtcacatttatgccaccattgtcttagttctataattaaatgtattcagtgctcaaggctagtccttttgttgatgtttcctcagtcatcacttggttcactgaaacttgtcctcatacctgtttaacagtttaggcgctagagaacttaccgttcaaaatcagacgaaattagggagccctcaatctagggcactaatcccaggtaggagcaccaccatctccttggcataggaacccaatttatttatacttatttcagcacttgggggcaagttctacagctgcacaaacagaaggagaaaatgagatggggcaaattgttcagctgtttatcccagtaaatctgcttgatttctttccacttttagaaaaagttctccttacctacttctctccttatgtaccgattttctccatagctatcccgtgaagaatgggctcccatctccacctgtggcttcgtctatgcatgattttatttgtggttttctatatttttccattcaccttccatctcctaaaatttcaaagtatctgatccactaacattgccctcaacccgtattctcaatgcctttattccttttcctatccttaatggttatttcagtgatacatgagaaaaaacaagtgtgctcacttgttgaataagaaattagatttctaacatttgagttagtagcttagcactgactgatgagagagaaggcatccctattgcgtagatccaatgtatctgttacaatgtaatttcaaaaaatagatttttccaatatggcttactaattcatgctaatttatatttttccaaaagtgcagcattttatttttaccacagctaactggttccaaataattgagttgaaagcataatgaaaaacagccttataaatagtaaagcataagataaattattgggtgtgaataaaaggaatatggaatgaaataaggcatgcctctgctgtgatctagagaattcacttcccctgtgtaaacctctatttccttggctataaaatgagcacattaagtgaagttaaggcccttctacctttaaaagtttatgaatctacatcttttataatttgtcaggcttacattaacctgattaaggaaaaatgcaaacttggaagcaaggcaatgaaaatagcatgatcttcattctgcatagatttatggagttcctaaattgtactagcagcagtagtggtgtactcaaaagcaaaagaaagcctcctcaacttttattatagtctacttcagttcactaagttgttttgcctagtaaaactaccttaaagttcaacttaggctcttagagcagatatgacactaagtaggaggccctgggatgagagatttgctgtatcaaagaaagaacaaagactaaggagcaacttgaatatgtttgtcaagattcaggaaggttggggcaggatgtgacggctcacacctgtaatcccagtactttgggaagctgagcttggagaactgcttgagcccaggagttcaagaccagcctggacaactatctctgaaaaaataaaataaaataattaaagaaagattcaagaaggtaggttggaaagttgcttggcttagcaagtgaggcagacactatagttggtcttctgactcttcataattatccctagttttgtttagataactacaccacccatatgtagcacatgtattttgggagaagccaactccatcactacttctagtagtcaggcatatgttcaggctaagtgaaccataattacactcacaaagcatagttttaaattaatggatgggcacataactcagaacctacaggacacaaaaaacagttttctgggggcatctgaaaaattccctcgctctcccagaaacgatctaagcttgctttctctgtatggaggtgagcaaagcacatgtgctccatgagctagccttaagataaagctggtatcatctggaaggcaaaattcagaggtggaaagacacaggatctttgattacaccatgtaacatctaagccatacggaccctaaaacttccacccttcctccaaattccccttttattgcttaagtgaacttgcaaggattttctttcccttgcaactggaaacatctgaatatatccaagatgcaaactcctgatgtataacacacaaacttgaaactgttcaacaactaagtccaaactaaggttaaatccatattcttaatagaagtcattgtgtgcactgactctgaggctgcaactattcatgagccatgttacaagagcatgtacctgtaatataacaactttagaagaaatgatgatgtaaaaatagctataaatgggtcaatatacattccagtttgtttagggcagtcataatttacccttgttgtcctgacataattatgaataggaccccattcactctcaagtgtcccagtttacacagttaccctgtctctaaagcatgtttttggatttgaatataattatctttagaaaaataacactaacccatggaaatgcctagagacctctaaaagatataagtgaattcgatctttaatccttgtgattggttttagaaagaagtggtgccagggaaaatgtgccaacaaagattcaatagccatttatcattttaaattttaaatatattattgtaatgtcctatctacttaactgctatgaagatggacactcagggtcacacagaccctcatttataagaagaatgacacagttcttatgaagacagagcaggaagcaagatatgaaagcactggcaggctctacattaaatacatatttcttctaccatctcccaccatatctaaaatacctctatagtcctaactcatttatttgtgttttaatttcttctgtagtcctctattaaactggactggtaccacacagtttattaatgacaatacctgatcagaagggagctggtttctggaaccaaggccccccaggacagaaggcagatggagtcaagaagggatgaaagtacctggtactaaacaagatgctcagcttagggcgtccatgacccttcttagcattttaagcaacacccatcatttgcacctttgtgtctctcaacagagaattttaccccagaagtcataaaatcttgaaaaacaatcacgactagtgcttgtttctgctctagtactattttaagacacatctgtgttcatttggctttttgatgctgtgacttttattctaatacacacattgatttgattaaaccaagttcagggataaggcaaatatacattcttgttcccgaaaacatcccaggcagtttcagcgtctttcagcacagatgaggtagggttggggctgcaatgtcatgcctaacctgggcttcagatctggaactagttcatgtggaaaatgcaaatgaaacctctgaagcaatgctgtaaaaaacaagaacatttccatccgagccaagtgttctccaagacaatgtcttcttcctaaacagaaaaagcagatacaataattttttaaacccacaatctttaccaaaattaatgtctaatatttggatgtcattcaggaaatctggaatttaaacaaagaaagagggaactatgtttattaaaggattttcttaaatctcaaagaatagaaattgacacttcagcaagcagaacccattcatttacctccttttgttagaccacggacttttgtaagactttagttccatctcccacttccctcctatgctgcaacagagcctaagatatgccacaaaagatctaatttgaggtgagacattttgctcaagaacagtccacttcatttcaactaagtgtgtattcttctccagtgaaggggaagagtttctagtccatcttccatgggtcttgtgtaccttttcacagaagaagcaatattttcctaattgaagatgaagtacaataaccagaagccaagagagtgagattctagttttacttaagtgactatatcttttccctctctgggtctcagtttctcaagctacctgttactgaattctcattccacaagttttgaaaaacagatttagaagaagccaggggttctcaaaagttcatctatagttaataaattaaggcttatattaagccgaaacagatgttaattacttccaatttaatcattctctcctgttagaatcagttctgtgtttttagaattgggatatttaattctatagaaggatgcttcagattaagatgctgtatctaatgaattatcattatcctttattctaaagttacgccccgtgaaagttctcttacctagggaaaaaggaaccaaagcttccttcttggcaaaatatccactgctgtccagaaatcgctcaggatggaacacttctgggtctctccagtacttttcatcaaagtgtacagaataaagatttgtaattactgttgtgcctttaggaatggaataaccacgtacaactgcatcttcagaggttgcatggaaaatccctaatggaactatattacagaatcttaaaacttcatgcaaaactgcctcagtataaggcattttgcatttgtcgtcccaagaaggcttcccattagggcccataattaaatcaatctctttctgaacttgtcctgtcagagaaaaagtattcaagttattatgcagttcttagaattatacctaaagttatttccctctggaataaaataaaggataacctataacaagccaataggatatagatacatccagattcagattttttattatctgggcgttctattgaaatatatgctatatatcttgtactaacagtagccagtgctctgataacctataacaagccaataggatatagatacatccagattcagattttttattatctgggcgttctattgaaatatatgctatatatcttgttctaacagtagccagtgctctgggtagctctattgtgaaagacataagtaataagaataaacattaaacatacctagaattggagtaagaaaaatagtaaagcataaaattagtttttaaaattctatcagagttcagattccagctctgccacttgcagacacacagtgttttttctcatttataaaatgggcataataagacctctttcagagattttttttacatgaattgagataatagatttgaaaactcttttttgtaactattaaatatttctatacttggctggcatcgcaggagttcctaaagaaaatgtattgtgcatggccaagactcaaaaacatgtatgaaccctacatgtaaggatagaccctgagatcatcaagagaatcctcaccttgaatattaggataaagggccatgaaaagaatcgcccaccgtagcacattggttgtagtttcagttccagcaatgatgagttcacccactgagaaaattaggttttctttggagaaagtagatgatgggtcatttttaccttgatccatctcatctaaataagcatcaacaaaatgctgaggtagctgaggctttctgttgactgaagctttttcaatgagtctggagagaaaatcatagactacagctgcatttctaaacagctgttgatgttttccaaaaggcaggatgccaatccatggaaaggcattatacaagaagactgaggcactggcagctagttccacattttcactaaataactcaatcatgtgctgaaaatcggtgtcttcataagtgaatcgttctccaaaaatgatcagattggttatgtttgaaacagcattcgttattaactgtttaaagtcaaaaggtctacctttgtatgtttcaatagcatcattgaaaaatttggtttcttccaagattttagattcaaaagacttttggccatatccaaaatatcgaaaactgtttacagctaatcgtctgtgatcaacccatcctcggccatatctggaattgagtaagcctgaaaaaaaatattaaaatattgtataattcctacttctctgtatctaaaaaatgaaagggaacaaaatttttttaatggatggttagtcatccttctccaaattgtcctcctatataactacatggttgggtcctgttctcagcaactcattagccagagtattataacagataaagtttttctactccttatctgtggactggcagaaaaggcctataattgcaccaccacaagaagctagtcagtcctgtgtaatttaacctggtgaaataggcccaggtgactatattatccaacttttactataagcctaatttaccaaagacaaatgaccacatgttcaatggacaaagttttatcttagactaaacaaacacctaaaaaatcatccttctaggattagaaattttctgcttaaaagagaatggattttagaaaataaatttcctcccattaaagggatatggtagacaatcaagtaactatgacaggggtaagggtactctgaatgagctgtcaatatagtcgaaatgctgaagtcaaaaaaagggcaaacatgaagctcaaa

SEQ ID NO: 68 - DNA, 101247 bp, Homo sapiens
cctgttcctgatgagttaatataagcaaaatccttttcaaatcccatctaagtgcctgttgttatgatcgtgtgtgtgcgtgcacttgtacatgtgtgtgcgtgtgcacgggcatggcgggttccatcctctcttcagaggcaggcaattgggtgggaggagtggatctatgacttctggcagagtgtagggagctttccatttgctcacgagggttcctccttggagcattcattgtcattgtaattcaggtgtgcagactgccagttcagactgtcctaggctggagacaggtggctgagtcaagggaagcattgcgtgttccggtggcctgggggctccccttgggggtgaaaaagggagggcgattccaggtctgcaagaagtggtgggcagcccagagcatcctgtttgttggagtcagggcagagcaggcttacagtcagctggcccccaagtgctttctcttgcaaccctgaagcccttgtgtcttgcagctactgcatatttaggtgtacaggggtgaagaggcgcacattggagtgttcttttccagcatgcatttgggctccttcatttgtgagaggaccacaaaggaagcccacctgagccagagtttgagaaagtccgtttcatcatggctgaccttaagaagcggaagtagagtacacaagtgctcagggtcattatcatatgcatcatcttaaacatttatctttctgtgtgtgtgtgttgaggtcatttaatatcctccttctagctatttgaaaccatatatcattggtaactatagtcatcttacagtgatatagaacattagaacttattcctcctatttagttgtaattgtgtatcccttatatgtataatctatacaattatatgtatagaaacatcacaatgcactccacaaatatgcacaattactcatccatttaacaaataattttattcttaccaaaagaagcagcagaagtgtgcaaagcaaatatttgccccttcatggattgtttcaaatcctttggcagattggatgtgggttattgttagggctgtaatgaggaatcagtgtctcagctggcagcagcagggatccgaggagaccttaatctacctcttcaaacccctgaagaacttccctaagcatctggctgacctcagaccagcactccaatgcccttctcttcaggaaccagtggaaggacccttcttggaattgctaatttctctccttcattataactcatgctatacatatttatttggtggtttgcttgtctttattgttaaggagtggctttagctgtacctttattttttttttttgaaattgaggaagatttgagaaaccaagtaaccttggaagtctgctggaatgagcttaactttttatttaagatgagctttaattgaccatagaagtgaaaagttcttaccaaagacggatattggaaagacatacatcaatgcttttatttccttattactatttgtattagaattaaactctttcaaatgaagagtctgggtgtaaaagaaaaattatgggccacttctgagattaacacccctaatatggtacctctagacatagtgagagcttttcatcaatattttgccagtataagtctgctgccctccgggatgaaattgcccaggctgggagagtaatttgatctcggagtgactttaatcaatgtgcttctgttaagcaaatatttccaatttttcagcagtttgtttgctgtgtaaatttcctttctctgccaatatgctgagctggcaccattaatttccacaggtgggacaaggctgttggcttccctgggttacttttcagcatgctgggagctggaaggatagaatttcacgagccattgcagccagctgccgagcacctggggcaacgtttgcagcaacccagggaccaccctctaacaccaagtgccccccacgttgctgaggaaggtccagttgtctgaggtttactttggacacatttttaatcatcgtggttggcacagacaggaaggctgagccagaacgaaatatctgggagccacagatattccagctggggtgaaactttctggagtgacctccgccaaagactactggtggcagctgcaatgacccacactctgctcctaaagcagtaccttaggagagagaagattaagagattccatgccctgtgtctctttctgggtcactcaaagggatgtgaggtgttctttcaagttacagcaactgaatgcataaaaattgctcaaggggaagcatcttcttaatgcgtttttgtccactctccctttagccctcagcagacagaaaaatcccttttaaatgtatttctaaacttatgttgtaaggaggcaaatgagaagcaaagctgaaattccagagggaacagaacacaaaagcgcttgtgcacgtgtaccctcaccttgcacacctacaccccagaggccagcctggcccaatgggctctgtttattcagtgttgtcttttcctgataattctgctgatgacagggaagcaacccttcttcttcttcagtctgcaatatttcaccctccaattactctttcaaattttgttttcaagtctctgcccaaatgctggacttagggagcccaaggctctcatttttgtatttctcttatgacacttgacattggctgccttgtcccactgcctacgcgagctcttttgaagacaaggactcttattggagctgagtcctgactccccactcagtgtcaggcatgtggaggcaaagtgcttcctctgtggctctgggtaagagctctgaccatgctgggctccagcaggttggccctgcagctggtttgtgtgtaagctgatggctgattgggcaccgtcaatgtgcaagccacatttctaatcaacttctatagaaaacactggagacagaagggcataatagctataatatatcttggtcttttgacgagaaggaatcgccaatacgtggggtgagaatttttccttcatgacgaatgacggcaacctcttctgagtgccgtctctgtgccaagtatggtgttcagtgctttcaagaatgttctctggctgggtgtggtggctcatgcctgtaatcccagcactttgggaggctgaggtgggcggatcaggagatcaacaccatcctggctaacacggtgaaaccctgtctctattaaaaatacaaaaaaaaaaaaaaaattagccggccgtggtggcgggcgcctgtagtcccagctactcgggaggctgaggcaggagaatggcatgaacccgggaggtggagcttgcagagagccgagattgcaccactgcactccagcctgggcaacagagtgacactccctctcaaaaaaaaaaaaaaaaaaaaaaaagttctctgatttgatttttgcaacaaatggaaagagacacacttccatgatgagcaaacagtttagagatacatttctaaagctagacccagaattggtgaagtcaaggctacctagcttcaaggcccttgctatcctgggttctaatcctaaaacttttctttgtccaaaatttgggtcccaagttatgtgaaagcttgagataaagaccaaagtttcattgctggtctgataatttttcatatgtaagatctggtttagagttttgtgcctagattggagtgcattccaacctggtttcctggttatctttttaactctggcctacagtgaattaaaccttccaccaactaagttaagaccaagtgtgctgagactgtcatttctgttggacataccaataagtattcagaggttgttttttatgataggcaatggagaaaaataactttctatttttcataagctgatgttttccctggtaagagttctttcatgattttgctgctatagaagaatgagccatttccaattggatagacacagtgatggattagtgttttgtcctctaaatccagaaaaaaacttctgatttccaaattgccaaagcagtgcttatatttggttctttgaatgattggttggcatcaattaacaataggtaaatgttcctgacacataaaagtcgccagctatatgataaaccacacagtagcagcttcaaagagtttgcctttggaaaggtgtttttaaataaaacaagtccaagaaacatgaaacagcaaattcatattcacacactggcaggcactgcagttaatatgagagaatgtattactttctggtagcaataaagaggtcttgattagtaaagtaggactttattggaaagtatgtggttcttaaaacccctcacacttccagggttatataccataaacaggacttttagataggaggatcatctgagaacacatatttaatttcttcccctccctaatttccactgggaagaaaaccagagcctgctccagtgctatagcgtgacacctgcattctggaaatgttgaggaatctctgcaggattggtactgctggatggaggaggagtttgcctgggcttccctttgtgtgaatgaacagcttgcttgggaggtgagtgggagggatctcaagaaacattgctagtacagggctgcaatctcatatctgagattccaaaatgtgagtagatttgaaaacgcatagcttttgctgtccatcaaaattggcaccaaaactgattttggccacaaaatgtaacctgaataacctgaactgtgatggatcatagtcatgactctgtgaacacaggaaaaaaaaattcagtggattaaatggtgaaaagtgtgatggattaatttctgtcctggacaatacacatttacctgtaaataagggatgatggctgtttactcagttagggactatttagaaacacatgattagtgagagcaaggacacaggaagagttttaaaaatcattcgtggtgctgcttcttcacctgagcacgtgctcccagcccagcatccatgtccaacgctagcctgctcatgacaagaaccccggatgacaccaatgcttcgtcagacgcagaggtggaagcacttagcctagtttgattcaacgtgagcttgaggttataatgaatgatgccttaaagaaagaattagagcaggccgggcgcggtggctcacgcctgtaatcccagcactttgggaggccgaggcgggcggatgacgaggtcaggagatcgagaccatcctggctaacacggtgaaacccggtctctactaaaaatacaaaaagaaattagccgggcgtggtggcgggcacctgtagtcccagctactgcggaggctgaggcaggagaatggtgtgaacccgggaggcggagcttgcagtgagccgagatggcgccactgcactccagcctgggcgacagagcgagactccgtctcaaaacaaaacaaaaaaatagtatttatggtctatatcacattatttcaccaaccagtttatttatttattttattttttgagacagagtcttgctctgtcgcccaggctggggtgtagtggtgcgatctcggctccttgaaacctctgcttcccgagttcaagcgattctcctgcctcagcctcctgagcagctgggattataggcgcctgccaccatgtccggctaattatttttattttattttattttttattgagatggagtctcgctctgttgcccaggctggagtgcagtggcatgatcttggctcactgcagcctccgcctcctgggttcaaacaattctctgcctcagcctcctgagtacctgggattacaggcacctgccaccaggcctggctattttttgtatttttagtagagacggggtttcaccatgttggccaggctagtcttgaactcttgacctcgtgatccacctgcctcggcctcccaaagtgctgggattacaggcgtgagccactgcgcccggccaatttttgtatttttattagtgacgatgtttcaccttgttggtcaggctggtctcgcacttctgacctcaggtgatccacccacctcggcctcctaaagtgttgagattacaggcatgagccaccatgcccggtgtcaccaaacagtttataacaatatacattaactatggaaaaactctaataggatttatatgattttatacactttatctcactcactggaactctccctatatttgcagaatgttttcttgattttacgaagttgtctgaaaccttcttgggatgtccgtgagtgcgtatggtgggctgtgtagatagtctgcccagagccctggggtctgtttttagaattttgttttcatgggctttcactttccagggccagttcttgagacctgaggccctttctgggaggactgccctcaaggcggctagtgtagactttgtgcctgaatcattggaagtgctgtaactatagtacctgagaacgtacgccttacctttccccccagcccttaactaatgactgaatggatgctccagtttcctggcctcaggtgacacatcttggaagtgtaacttacactccacagtagctctccaagatgctttcctgttatcacagttgtccttctcctgtgtctacctttctatgttctgagttctgaaacacagctggccccaaaggacacagaaaaggaattgaagacctgtgtcctcttccttggtggggctagggctggcagagaggataggccacagagccttggcagactcttctccatcccaccctctcctcctggaagttcaccaggcattgcaggctgcatgagcccctagaggcatgtgttcctgccagtcctgggtgtcagtggccaacagagcgcatggctgactcctactgagaacagcttttctagacaatgagtgggtgctatggcctgagtgatgcctaattgctggccagaatacagacaggaatttctaggacatgctgatgaagctccttgaagctgcaatagctgttggtcctaggcaaccaacagcaagaaattacttttcaaagagcaaagtaataccacactttattcaaatatgtgccctcttttcttaatttgggccagactgatatgaccagaggcttttatgttcttaggcagaaatcatctcaaatgccagtgatggataagcaaattcctttctctataaattgagaaaaaggagaaaatcattactgaacatattttaaaaaatgctttgcactgaagaattacagtaaatgattactcttgtgtcttagtctgttcagactgctataacaaaataccatagacctggtggcttataagcaatggaaatttatttttcacagttctggaggccggaagtccaagatcaggctgccagcatggtcaggttttgcggagggccctcttccagatgggaagatgatgacttactcatctatcctcacatcatggaagcagggaactttggtcgctttagccccttatggggaactactatggggcacgatctcattcatgagggctgtgctgtcatgatctgatcatctcccaaagtccccacctcctatgacaatgaggattaggtttcaacatatacatttttggagtacacaaacattcagaccatagcatattgttaataaaagttgcagaaaagaacattgagaaacatggactagatatgcaacaagattcaagatagaattatctctatggtaattgcttgtcacaaagaaggaacagttgagagcaggaaatcctgcaaggagaggaaaactttgttaaatttaaaatgccaattacaggcacctgccaccaggtctggctaatttttttatttttattttatttattttatttttttattgagacggagtcttgctctgttgcccaggctggagtgcagtggcgtgaggcaataaacagcaaattggagactctaggaatttaatcagtaaaaataccagcttgagaaattttcccaggagtcaatctaaaatgagagaatggataagagttgtgagcacttgtctagaagatgtgatgcatacaaaacaaaaattcaagaaagaaagcagaaacagtagtcaaataaatggacatcaacttgtctgagttgaaggaacacatcagagtctttcctgtacattagataaaacccatgataagaaaataatcatctagagccatactggtaaagttttgcatataaaaaatatgcaggatgaaaagagcagattaaatatcaataaaccaaatccatcattttctaaatcaatagcatagaaaggcaattgaatcaagtctgcagagttttgatgggaaagactgcagagtccttcctgtatgcagagccacatgactgtcctgtgccctggacacttttgccttggtgggcctcttcctttacaaaaagacattacaagttatctttgtaaagacagctgggtgcagaggctcatacctgtaatcctggcacatcgggaggatgatgtgggaggattgcttgagtcccggagcttgagactagcctgggcaacacagtgaaatcccaactccacgcacatacaaaaataaaattagctgggcatggtggtgcacctgtagtaccagctactctggagactgaggcaggaggatcgcttgagcctgggaagtcaaggttgcagtgagctgtgattgagctactgcactctagcctgggtgacggagcaagaccccacctttaaaaaaaaaaaaatgactagtagaatccaggctggatcacattcattttttctcccaatttttaaagaaaatattttttaggagttcctgaaattatcttaggctcttggcactgtgtccactgagcgtaatggagaaattggccctgcctgtaaaagaaacttccagacccaccccaggggctccaaaatgtcaaacgctatttataaactcttctcgaaaaacttgaatcttttcgagtggttctggacatataatcatatcatgaattaggaagttgtggtttcatagaattggccatggaccatacaagacatagaagtctaaacaatttttattaatatgattatgaaaattattccctaaagagtagataaataatgctaaatatattaaataatatacatttaaatatttatttatatacatttaaaatcctaagtcattaaaaccttgaaaattatgaaagcaaggaagaaaaaaaaaggcaagctaactatttctgctcacaggtagggcttatagattttttttttttttggagagaaaagggattttattttatttattttatttttttaaattcaattacctttatttcttttaggatttaaccttatgtgaatcatattaagacaatgatacatttgcatttgaggtgtttatgattcaactaagtttccctctgctttttctttttttatatatatattttttattatactttaacttctaggatccatgtgcacaacgtgcaggtttgttacatacgtatacatgtgccatgttggtgtgctgcacccattaacttgtcgtttacattcggtatatctcctaatgctatccctcccccctctcccttcccccaccccacaacaggccccagagtgtgatgttccccttcctgtgtccaagtgttctcattgttcaattcccacctatgagtgagaacatggcggcgtttggttttttgtccttgcgatagtttgctgagaatgatagtttccagcttcatccatatccctacaaaggacatgaactcatcattttttatggctgcatagtattccatggtgtatacgtgccacattttcttagtccagtttatcattgttggacatttgggttggttccaagtctttgctattgtgaatagtgccacaataaacatatgtgtgcatgtatctttatagcagcatgatttatattcccttgggtatatacccagtaatgggattgcggggtcaaatggtatttctagttctagatccctgaggaatcaccatactgtcttctacaatggttgaactagtttacagtcccaccaacagtgtaagagtattcctgtttctccacatcctctccagcacctgttgtttcctgactttttaatgattcccattctaactggtgtgagatggtatctcattgtggttttgatttgcatttctctgatggcccgtgatgatgagcattttttcatgtgtctgttggctgcataaatgtcttcttttgagaagtgtctgttcatatccttcgcccactttttgatggggttgtttgtttttttcttgtaaatttgcttgagttctttgtagattctggatattagccctttgtcagctgagtagattgcaaaaattttctcccattctgtaggttgcctgttcactctgatggtagtttcttttgctgtgcagaagctctttagtttaattagatcacatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattgatttttgtatagtgtgtaaggaagggatccagtttcagctttctccatatggctagccagttttcccagcaccatttattaaataggaaatcctttcccgatttcttgtttttgtcagttttgtcaaagatcagatggttgtaggtgtgtggtattatttccgagggctctattctgttccgttggtctacatctctgttttggtaccagtaccatgctgttttggttactgtagccttgtagtatagttttaagtcaggaagcgtgatgcctccagctttgttcttttggcttaggattgacttggcaatgcagactcttttttggttccatatgaactttaaagtagttttttccaattctgtgaagaaagtcattggtagcttgatggggatggcattgaatctataaattactttgggcagtatggccattttcacgacattgattcttcctatccatgagcatggaatgttcttccacttgtttgtgtgttgttttatttcgttgagcagtggtttgtagttctccttgaagaggtccttcacatctcttgtaagttggattcccaggtattttattctctttgtagcaattgtgaatgggtgttcactcatgatttggttctctgtctgttattggtgaataagaatgcttgtgatttttgtacattgattttgtatcctgagactttgctgaagttgcctatcagcttaaggagattttggactgagacgatggggttttgtagatatacaatcatgccatctgcaaagagggacaatttgacttcctcttttcctaattgaataccctttatttctttctcctgcctgtttgccttggccagaacttccaacactctgttgaataggagtggtgagagagggcatccctgtcttgtgccgtttttcaaagggaatgcttccagtttttgtccattcagtatgatattggctgtgggtttgtcataaatagcacttattgagatacgtcccatcaataccttattgagagtttttagcatgaagtgctgttgaattttttcgaaggccttttctgcatctattgatatatggtttttgtctttgtttctgtttatatgctggattatgtttattgatttgcgtgtgttgaaccagccttgcatcccagggatgaagcccacttgatcatggtggataagctttttgatgtgctgaaggattcggtttgccagtatttcattggtgatttttgcatcaatgttcatcagggatctcggtctaaaattctctttttttgttgtgtctctgccaggctttggtatcaggatgatgctggcctcagaaaatgaattagggaggattccctctttttctatagattagaatagtttcagaaggaatggtaccaactcctccttgtacctctggtagaatttggctttgaatccgtctggtcctggactttttttggttggtaagctattattgcctcaatttcagagcctattattggtctattaagagattcatcttcttcctggtttattcttggaagggtgtatgtgtcgaggaatttatccatttcttctagattttctagtttatttgtgtagaggtgtttatagtattctctgatggtagtttgtatttctgtgggatcagtggtgatatcccatttatcagtttttatggtgcctatttgattcttctctcttttcttctttattagtcttgctagtggtctatcaattttgttgatcttttcaaaaaaccagctcctggattcattgattttttggagggttttttgtgtctctatttccttcagttctgctctgatctcagttatttcttgccttctgctagcttctgaatgtgtttgctcttgcttctctagttcttttaattgtgatgtcagggtgtcaattttagatctttcctgctttgtcttgtgggcatttagtgctacaaatttcccgctacacactgctttaaatgtgtcccagagattctggtatgttgtgtctttgttctcgttggtttcaaagaacatctttatttctgccttcatttcgttatgtacccagtagtcattcaggagcagcttgttcagtttccatgtagttgagcagttttgagtgagtttcttaatcctgagttctagtttgattgcactttggtctgagagacagtttgttataatttctgttcttttacatttgctgaggagtgctttacttccaactatgtggtcaattttggaataggtgtggtgtggtgctgagaagaatgtatattctgttgatgtggggtggagagttctgtagatgtctatcaggtccacttggtgcagagctgaattcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttagtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagtctcgatggtctttacaatttggcatgtttttgcagtggctggtaccgtttgttcctttccatgtttagtgcttccttcaggagctctttagggcaggcctgctggtgacaaaatctctcagcatttgcttgtctgtaaagtattttatttctccttcacttctgaagcttggtctggctagataggaaattctgggttgaaaattcttttaagaatgttgactattggcccccactctcttctggcttgtagagagtttctgccaagaaatccgctgttagtctgatgggcttccctttgtgggtaacccgacctttctctctggctgcccttaacattttttccttcatttcaactttggtgaatctgacaattatgtgtcttggaattgttcttcttgaggagtatctttgtggtgttctctgtatttcctgaatttgaatgttggcttgccttgctgggttggggaagttctcctggataatatcctgcagagtgttttccaacttggttccattctccccgtcactttcaggtacaccaatcagacgtagagttggtcttttcacatagtcccatatttcttggaggctttgttcgtttcttttaattcttttttctctaaacttcacttctggcttcatttcgttcatttgatcttccatcactgataccctttcttccagttgatgaaatcggctactgaagcttgtgcatttgtcacgtagttctcgtgccatggttttcagctccatcaggtcctttaaggacttctctgcattggttattctagttagccattcgtctaatcttttttcaaggtttttaacttctttgccatgggttcgaacttcctcctttagctcggagaagtttgatcgtctgtagccttcttctctcaactcatcaaagtcattctccatccagctttgtttcgttgctggtgaggagctgcattcctttggaggaggagaggcgctctgatttttagaattttcagtttttctggtctgttttttccccatctttgtggttttatctacctttggtctttgatgatggtgacgtacagatggggttttggtgtggatgtcctttctgtttgttagttttccttttaacagtcaggaccctcagctgcagggctgttggagttcgctggaggtccactccagaccctgtttgcctgggtatcagcagcggaggctgcagaacagtggatttttctgaaccgcgaatgctgctgtctgatcgttcctctggaggtttcctctcagaggagtacctggccgtgtgaggtgtcagtctgcccctactcgggggtgcctcccagttaggctactcaggggtcagggacccacttgaggaagcagtctgtcctttctcagatctcaagctgcatgctgggagaaccactactctcttcaaagctgtcagacagggatatttaagtctgcagaggtttctgctgccttttgtttggctatgccctgcccccagaggtggagtctacagaggcaggcaggcctccttgagctgcagtgggctccacccagttcgagcttccggtcactttgtttacctactcaagcctcagcaatggtgggcgcccctcccccagcctcgctgctgccttgcagttcgatctcagactgctgtgctaccagtgagtgaggctccgtgggcgtgggaccctcccagccatgcacaggatataatctcctggtgtgccatttgctaagaccattggaaaagcacagtattagggtgggagtgccccgattttccaggtgccatctgtcacagctttgcttggctatgaaagggaattcgctgaccccttatgcttcccgggtgaggcgatgcctcaccctgcttctgctcatgctcggtgtgctgcacccactgtcctgcacccactgtccaacaagcctcagtgagatgaacccgatacctcagttggaaatgcagaaatcacccttcttctgcgttgctcatgctgggagctgtagactggagctgttcctatttggccatcttggaaccgccactgtagatgttatttaatttttgacattgaccatcagagaaaaaggagttcagctatatatgtgtgtgtgtgtgtgtatgtgtgtgtgtgtgtgtgatgtgtatatatgtatacttttttcttttattttttgagacaaagtcttgctttgtcatataggttggaatgtagtgacctgatcacagtgcactataacctcgaagttctggactcaagtgatcctcctggcttagcctctctggtagctaggactatgagtgttcaccaccgttaattagcccaactaatttaaaaaaaattgtagagacaggggtctcgctatgtcacatgggctggtcttgaactcctggcctcaaacaatcctcctgtctcagctttcccaatgtactagattatgggcataaaccactgcatctggcttcaaatgtattgtttaaattgaaataacttgtagaacagaaacaggaatagctttaaatcaatggataaaggaaaacataccatttagcatagaacaaaaagtagaaaagggcaagaaagtgtgagaaaacaaagcatgaggcagaaggacagtagtatagtcacattttgtgatgataaatttgtcatagaacaaaatctagtgaagctatatgctactttagagacatctacaaattacatgtttaagttaaaagtgaaagacaaaaatggacttgaaaaaatacaacgaaggaagatggtattttaaaaatgagacaaaataaaaatctcagaaaaaaccataaatggaacaaagagctaaagcgcacaagccacaataaatatttagaaattgtttactcttgtatgatgaataacagcataaaagcacaagctgataactacaaatatgaggaaaaggcaaaaatttagtagcaagaagagaactaaatacattattcatctctaacaaataagaaaaatcaatatataaaatatttgaataaatgacttaataagtttgatttaatagatataatttaaattttgtgtcctacaggatattaacatatgtttgtaaactaccgttcacattttaagaaagctgacatttgaggcagtaaatgaaattttagtaggttaagaatggacactttttggtgattccattgaaaaaatattaaagattaaaaaaaggttgactggccgcgatggctcacacctgtagttccagcactttgggaggctgaggtgggtggatcacctgaagtcaaaagttcaagaccagcctggctaagatggagaaaccctgtctctattaaaattacaaaaattagatgggcgtggtggctggcacctgtaaccccagctgcttgggaggctgaggcaggagagtcacttgaacccgggaggcggaggttgtagtaagccgagaccatgccactgcactccagcctgggcaccaagagtgaaactccgtctcaaaaacaaaaacaaaaacaaacaaacaaaaggtttacaaagtaatgttatggagaatggtggagtagggagtgctaagtatccctcccttcactgaagctcgattaagctgcccaaaactgtcagaataaactctttcaaaactctagaatctaaaaagaaacttataacaatcagggaagtacttaatgaagagagaagctgctaaattttgatgacagcattttggatttttttgcttatttgcttataattctccattattcagctaagcagtggtcacaggactgacaccagctaacgttcttggtgtcgcttgatgccatcccagggggccgtatggaccttgttctcaaagaattgtggctggagttttgatctgtctggtgccaaccgagggatgaattctatgtcttgtctttgtttcagccctttggaacactgtcaggactggaatggcctcctggattgtggctgtcaaaagcatttaatagcatatacaggcacctgccaacatacccagctaatttttgtgtttttagtagagagggggttttaccatgttggttggccaggctggtcttgaactctttttttttttgagacggagtctcgctctgttgcccgggctggagtgcagtggtgcgatctgggctcactgcaagctccacctcccggattcacgccatttccctgcctcagcctcccgagtagctgggactacaggcacctgccaccatgtccggctaattttttgtatttttagtagagatggggtttcaccgtgttagccaggatggtctcgatttcctgaccttgtgatccgcccgcttcagcctcccaaagtgctgggattacaggcgtgaaccactgcgcccagccggtcttgaactcttgatctcaggtgatccacccccatcggcctcccaatgtgctaggattacaggtgtgaaccaccatgcctcaccctggaatatttttaaaaacacactaaggattgtatttttcagtacttttcaaactgttcgggggcatgagctccatacactgccgattacccattgtgtgtcaggtttccaatcgccaggatgttaatgttctcttcttagttaagatttctttcagggaggccgaggtgggcagatcacctgaggttgggagttcgagaccagcctgaccaacatggagaaacccagtgtctgctaaaaatacaaaaattagccggttgtggtgggggcatgcctgtaatcccagctacttgggaggccgaggcaggagaatcgcttgaacccgggaggcagaggttgcagtgagccgagatcacgccattgcactccagcctgggcaataagagtgaaactcctcaaaacaaaacaaaacaaaacaaaccatatgtatatattatatacatataaaatacacagaatattggtattttataggaaaaatatataatatattggtataggtataagactgtaaaactgacagtccttcctcaggtggtgaattaagaagctgagtatgtctttaaggaagcagctctctcctggtcagactcttttcattatgttcactgtctttttaaattgttcgtacagcaaaatacacaatttgatggatttggtcaaatgtgtttgacaaccatgtaacccatcaagttatagaacatttccatcaacacagaccaggatttctcagcctctgcctttgttgtgggggggctgtcctgtgtattgagggctagttaacagcatcctcgacctctgcccactagatgccagtagcatgacaatcaaaatatcttcagacattgctacatgttcccccagggacaaagtcacccctggttgagaataaccgccatagaatgtttctttctggcccattgcaatcaatccccctttctcccagaggtaactactcttctgacttacatctctatagattagttttgcctgttcttgaactttttataaatacaggtacacagtatggtctcttttgtgtctgtcatccttagctcaacgtaatgtccatgagagtcttatttgttgtatcagttccaagatatcaatagaccgtggttggttagccattctccctttcatggacgtttgggctgtttccagtgtttggctattatgaacaaagtagctgtgaacattcttgtacaactctttgtgtaaacacatattttcatttcttctgggtaaatatgcaaggtatatggcaggtaaatatttaactctacaagaaactgccaaattgttttccaaaatggctatatcattttacgctccaaccagcagtgctgagagttccaggtgctccacaatctccccaacgtttggtgtcatctgtctttcattaggcattctggtgggtgtgtgttatctcattgtgcttctaatgtgcatttccctaatgactagtgatattgaacaccttttaatgtgtttatttcaaatatatatatcagacaaatgactcgcatctagaatatatacaaaactctgaaatcaatattaaaaaagacaaataatccaatgaaaatgggcaaaactcttcacgaaagaagcatgaatgtcacatttttgttgtatcttttccacactcccactcatcacttctgcactggatgctgctctttgttgaacaacagtgcttacttagtgtgtgtcaaacccatttctaagcacttgacaatgttaactcacttacccctcaatattagcccatttaattctcaaaacagccctataaggtattattattcccactttagagaagaggaaactgagacagtgagtctaagtgatttgctaaaactcacagctggttggatgaaggatccaggattccggcccaggcagcctggctccaagctcttaaccacgatatgcacagtgtgcgcttctccttacaaggcagatgctatgaggtatctcaatccctctgctgcactttctcaaagtgagttttcaaaattttatcagtaacaggatgttgggtttcagatacccgtaatacagaatcgatatgtttatgttgccatttctactgctgattgctgttactcaattttccatcgttttgtaggtgccttaggagctgtgactttgatgtctcctgtaggtaaaaagatgtttttcaaatcccttccaactgtggtccttcttgtggtactaggaaaggctttatagttttctttaaggaaaaaaagaaaaggattaaaaaaagaaaagataaattttggtttgagagctgcctgaaaagatttgcctgctctaactcaaaagcttttcctccatcgcatttctgaatatcactagggaccccttacctttctcctctcttctctccctccatcagtagtgactggggttaaaagttacctgcttgcagcaagattctggttcacctggtgatatggcttggctgtgtcccaatccaaatctttttttttttttttttaatatactttaagttctagggtacatgtgcacaacgtgcaggtttgttacataggtatacatgtgccatgttggttcgctgcacccgtcaacttgtcatttacattaggtatttctcctaatgctatcccttccccagtcccccacccactgacctgccctggtgtgtgatgttccctgccctgtgtccgtggttctcattgttgagctcccacctgtaagtgagaacatgcagtgtttggttttctgtccttgttatagtttgcttagaatgatggtttccagcttcatccatgtccctgcaaaggacgtgaactcatccttttttatggctgcacagtattccatggtgtatatgttccacattttcttaatccagtctatcattgatggacatttgggttggttccaattctttgctattgtgagtagtgccgcaataaacatacatgtgcatgtgtctttatcatagaatgatttataatcctttgggtatatgccaagtaatgggattgctgggtcaaatgttatttctagttctagatccttgaggaatcgccacactgtcttccacaatggttgaactaatttacactcccaccaacagtgtaaaagtgttcctatttctccacatcctctccagcatctgttgtttcctgactttttaatgatcatcattctcattctaactggcatgagatggcatctcattgtggttttgatttgcatttctctgatgaccagtgatgatgagcatttttgtatatgtctgttggctgcataaaagtcttcttttgataagtgtctgttcatatcctttgcccactttttgatggggttgtttttttcttgtaaatttgtttatgttctttctagattgtggatattagccctttgtcagatgggtagattgcaaaaattttctcccattttgtaggttgcctgttcactctgatgatagtttcttttgctgtgcagaagctctttagtttaattagatcccattggtcaattttggcttttgttgccattgcttttggagttttagtcatgaagtctttgcccatgcctatgtcctgaatggtattgcctaggttttcttctagggtttttatgatgttaggtctaaaagtctttaatccatcttgagttaatttttgtatatagtgtaatgaagggatccagtttcagctttctccatatggctagccagttttcccagcaccattcattaaatagggaatcctttcccgatttcttgtttttgtcaggtttgtcaaagatcaggcggttgtagatgtgtattgttatttctgaggcgtctgttctgttccattggtctatatatctgttttgatatcagtaccatgctgtttttgttactgtagccttgtagtatagtttgaagtcaggaagcgtgatgcctccagctttgttctttttgcttaggattgtctttgcaatgcgggctcttttttggttccatatgaactttaaagtagttttttccagttctttgaagaaagtcagtggtagcttgaggggatagctttgaatctgtaaattactttgggcagtatggccattttcacgacattgattcttcctatccatgagcatggaatgttcttccacttgtttgtgtgttcttttatttcgttgagcagtggtttgtagttctccttgaagaggtccttcacatcccttgtaagttggattcctaggtattttattctctttgtagtaattgtgaatgggagttcagtcatgatttggctgtctgtctgttattggtgtataggaatccttgtgatttttgcacattgattttgtatcctgagactttgctgaagttgcctatcagcttatggagattttggactgagacgatggggttttgtagatatacaatcatgtcatctgcaaacagggacaatttgacttcctcttttcctaattgaataccctttgtttctttctcttgcctgattgccctggccagaacttccaacactctgttgaataggattggtgagagagggcatccttgtcttgtgccagttttcaaagggaatgcttccagtttttgcccattcagtatgatattggctgtttcccattcaaatcttagcttgcattgtatcttccagaatccccacttgttgtgggagataattgaatcatggtagctgatctttcccagactacttttgtgatagttaataagtctcatgagatctgatgggtttatcaggggtttctccttttgcttcttcctcattttctcttgctgctgccatgtaagaggtgccttttgcctcctgccatgattctgagacctccccagccatgtggaactgtaagtcctattaaacctgtttttcctccaagtcttgggtatgtctttatcagcagtgtgaaaatgaactaatacagtaaattggtagcagtagaatggggtattgctgaaaagatacccgaaaatgtggaagcgactatggaactgggtaacaggcagaagttggaacagtttggaaggctcacaagaagacggaacatatgggaaagtttggaaccccctagaaacttgttgaatggctttgcccaaaatgctgatagaaatatggacaataaggtccatgctgaggtggtctcagatggagatgaggaacttgttggaaactggagtaaaggtgactcttgttatgttttagcaaagagactggcagcattttgcccctgccctagaaatatgtggaactttgaacttgagaaagatgatttagggtatttggcagaagaaatttctaagcagtgaagcatttaagaggtgacttgggttctgttaagggcattcagttttataagggaagcagagcgtaaaagtttggaaaactttcagcctgactatgtgatagaaaagaaaaacccattttctggggagaaatttaagccagctgcagaaatttgcataagtagcaaggagcctaaggttaatccccaagaccatggggaaaatgtcttcaggccatgtcagagaccttcatggcggcccctcccatcacagacccaggaggaaaaagtggtttcatgggccgggcccagggtccccgtgctgtgtgccgcctagggacttggtgccctgtgtcccaaccactccagccatgactgaaaggggccaacgtacagcttgggctgtggcttcagagtggaagccccaagccttggcagcttccatgaggtgttgagcctgccagtgcacagaagtcaagaattgaggtttgggaacctttgcctagatttcagaagaggtatggaaacacctggatgcccaggcaaaagtttgctgcaggggtggggccctcatggagaacatctgctagggcagtgtggaagggaaatgtggggtaagagtccccagacagagtccctactgggacaccacctagtggagctatgggaagagggccactgtcctccagaccccagaatggtagatccactgacaatttgcaccgtgcacctggaatagccacaaacattaaacaccagcacctgtaatagccgcagacacaaaacgccagcctgtgaaagcagctgggaggaaggctgtaccctgcaaagccacggggcggagctgcccaagaccacgggaacccacctcttgcatcagcatgacctggatgggagacctggaatcattttgaagccttaaaatttgactgccctgctggatttcagacttgcatgggccctgtaacccctttgttttggccaatttctcccatttggaatggctgtatttacccaatacctgcacccccattatatctaggaagtaactagcttgcttttgattttacaggctcataggcagaaggtacttgccttggtctcagatgagactttcgactgtggacttttgggttaatggtgaaataagttaagactttgggggactattgggaaggcatgactgattttgaaatgtgaggacttgagctttggaggggctaggggcggaatgatatggtttggctgtgtccgcatctgagtctcaacttgaattgtatctcccagaattctcatgtgttgtgggagggacccaagggaaggtaattgaatcatgggggctgatctttcctgtgctattctcatgatagttaataagtctcacaagatctgatgggtttatcaggggtttttgcttttgcttcttcctcattttcacttgcttctgccatgtaacaagtgccttttgcctcccgccatgattcagagacttccccagccatgtgcaactataagtccaattaaacctatttttcttcccagtcttgggtatgtcgttatcagcagtgtgaaaatggactaatacacctgggtttacagcctttctgttccatacccactggatgggttatttatgtgccattttatttggaactactgttactttcctaataatataacaagattttgtgtgtaagactcttctcactattatcttactcgtttgaatttgtttcattttaataaggtaatatttaaattgcacttaggaactagtaatatatatgtttaaacatactttaatgttgtgtataatcacaaactaatattcatttaagtgcaggggactgtattcatccagttaatccaataaacatttattgaatacttgctatgtgccagggaccatggggagatacaagtgaggtatagttttgttcctatcacgcagatgcttgaaacatctagtcagatacatgttaattaccattgagtttcaaaagttctctacctccaagggaggcaacagtagccttcacgacctcacagtggtcttggcgtgagcagccctccatggcacagatcttgagctggtctactccgtgccagcagaggaactagactttgagaaacgagttggatttagaacagtgacaaatgagcaggtgtgaggtggcactccaggtacatagaagagcatagttaaaggcatgtggtgagttgtccagttcatttccctacaggccaagagctagtgagatgcaaatctggggctgagggtgtggaggcctcttttgccatgaatgttgggcaaaagaatgttctgtggcaaatacagactgttcccaccatctctaaatggtaggatgtgagaagtagagctagaactggcacatctcctccataaccgtttttcaaagccacatggaaatattacaaaggcttgacaattcacagggcaactaaaataccaactacaatacttacgacagatgtcctctctaagtagcacattttcaagtgataaacaatagagatgtctctcggtctccctcttctgtcacagtctttggacagtttttttgacttttctttgaatattgtggaggaagtgttggtatctgagacttttcaaaaaacaaatattgtcatgcaggtggatatagtccaggagttgattttatgttcaggagggcttccaaaagtgcctggattttccaaaagcctattttaaagggcaatttgattcaacatgaagatattgaaatgtagtggctgggcgcagtggctcatgcctataatcccagcactttgggaggccgaggtgggcagatcacttgaggtcaggagtttgagagcagcctggccaacatggtgaaactccatctctactaataatacaaaaattagccaggtgtggtggtgcacacctgtaatcccagctgctctggaggctgtggcgggagaattgcttgaacctaggaggcagagtttgcagtgagctgagattacgccactgcactccagcctgggtgacagagtgagacgccatctccaaaaaaaaaaaaaagatattgaaatgtaataaaagcaaatgtacctagaagtaactggtgacccaacgttatgaacaactgaaataattccctctctgtactgaagggctggggtgcgcagtgccgaatgatctgggtgtcggcttcccacatgctatgatttttggctcacagaacattgagatcagaaaggagcaagaccctcaggatattccaactatcaggatgcaaagagaatggctatggtagcatgactgcactcttcaacctcctctctatactagctagggaagttgctggcttttaaaatgaagctcttcattacataatctgcactgctccttccaaggaccattagagggaagacacaataggtggcactttctttctttctaccaagcagagggtttcttgtgtaaaatgctgtgttctctccattcttcagtagaactacgaagcacacacgtttcattgagtcacaggagaagcacccaccatcatgagtaaagccctgtgcggacacagtgggttaaaaacagatatgacatggcctcttcccatggaggccacatctgggagttggaggagagacatacacttataaccacaggtagcatttacaaaagcgacatgaactagatgctgtgagaacagaaggcctgagatggtaaaatttggccaagggagctgagaaatgcttctatgttgaaatgacacttgggatttgtaggaggccttggttttgccaggtggatgagtaggaaccttccaggtagagggcatactcagtctgtgtgaggatacaaaggcatcctgggtttggactgtatgatcccatttatttatttgtttgtttgtttgtttgtttgtttgatggagtctcggtctgttacccaggctggagtgcagtggtacgatgttggctcactgagacctccgccttctgggttcaagcagttctcctgcctcagcctcccgagtagctgggactgtaggcacctgccaccacacccagctatttttttgtatttttagtagagatggggtttcaccatgttagccaggctggtctcgatctcctgacctcagatgatctgcccgctgggtttggactacatgagtgagaaggcaggaaagctgaaagatcaggtgggtaagattgtcggggccatattgtcacagaccttcacctctatgaagaagcatttagacttgatcttgtaggtcttggggtgacatagactatgctacgcagggaagtataatgagagcagtgttttggagagacaccggcaacagggaggaggaggcctggactcactcatgcagggctggcaataagaaatcactttgggaaggtatttaagtagtcattcaatggccatgtttgtggtgtgaaagataacgggctctgactcctgactccttgggtgtgaatcccggctctacctcttactatctgcatattcctgtgcaagttactcagtctttctgtgccttggtttctttgtatataaaatgaagataatagcagttactagagccgtgcttctcgaactggaatagaatatgcacaaacatcagcttgttaaaatgcagactctgccaggcatggtggctcacgcctgtaatcccagcactttcggaggctgaggcaggtggatcacctgaggtgaggggttcgcgaccagcctggccaacatagtgaaaccccatctctactacaaatacaaaaaattagccaggtgtggtggcacacgtctgtagtcccagctactcaggaggctgaggcaggagaatcgcttgaacccgggaggcggaggttgcagtgagccaagatagcaccattacaatccagcctgggcaacaagagcgaaactctgtctcaaaaaaaaaaaaggagactctgatttagtgaacccagggtggaacctgaaattctgcaagctcctggatggtggtgatgctgctgtcccatgggccatgctttcggtagcaagatttctaatgactgtttcgaagattatatgagtaaatacatgtaagaaacacgaagagcagcatgtggcatagtaagagatagctaatgttagggtccaggagaaagtctaaaaatatatctcaattactgctttacaagagttttatgcactagaaagttctctaaagacaattacttggtattttgtctccctttctggccagctacctgcagagggttagtgtggctcagttctggagagggaatccaagcgacctgtaataataggcaatgcaattcagccgcaggcaaggtggccacacagtttatgaaggtacttacccctgtgtctcttccaggtctcccataaagtttggttagatgacaggatcatcagaactgtcctaagtgggacatgaggtttccatgtgcagcgagctccaggaagatatgggccgactgttgagtaccctgtaaactctagggattttagctgcagcttcagttggggctgagatgggctacctgctgactttctcatagagcagagaagaccaagggtgaaaaagcgtatgcttgaattttgcagagatattaggaaaattgggtatatgagattgaatgacaaagaaaaaaacaggcaaataaactttgttaagtacttagattttattttctctttaaaggcaggctttggccagaaaaaaaggaaaaaaaaaaaaaagaaaaagccccaaacttctctctttttctcttttggctttccccaatctcccaccctactttcagcagctttgtttttgtttgtttttgctgtgaaaaataagccctgcttggggagtgaagagtgggtctccagtgaagaacttcaacaggacttctaaagtattaccttaaaggccattgtacatgagaagtaaatatgttttattaagcagaaattttgcaacatgcatatacttgactctttgtgaaaagctggaaaaactgaaaagaaaaggaaaaatcctaataagtaaaacttcaaatggctccagagagtcattccacagacatttctctatggcatttctgatacatgtaaggaaaagataaatagtaattacttgggcttgaaagcttggctttttctttttttgagatggagtctcactctgtcgcccaggctggagtgcagtggcgcgatctcgactcactgcaacctctgccctccgagttcaagggattccctgcctcagcctcctgagttgctgggattacaggcgcctgccaccgcgcccggctaatttttttttttttttgtatttttagtagagacggggtttcaccgtcttggccaggctggtcttgaactcctgatctgtgatccacttgcctcagcctcccaaagtgctgggattacaggcgtgagccaccgcgcccggccacaccttggcttattttttaatgtccgactggaaaaccatggttgcttaactgtgctacttggaacaagtacccaagccttagttttaatacctgcataattcaggatagtaaatgaaagatttgctgtgaatgttcctcaagtctctcttgtgcctggcacagtgtaggcactccaaaaatgtttgctgaatgaatgaatgaatgactaaataaataaatgaaagctcacgggctacattttgcttagataaaaccccagttatcttttttttttttttttgagacggagtctcaatttccatcctttccttcttgaaactcgcctccctgttcttccacaatacttctgagattctcaatcaggtctgtctatgcaatggaaggactggttgatgcaactgagttctgattggtcagtataaatgagccttgatgggttgataaaactgagccgtgattggccagggcaggtatctctaattggttggttcaggtgagctctgattggttggtttctgagacaaacataggaagtctctgtgagatgtttctttaaaatggccagtgggggtaggggtagctggatttcttgctgcagtttatcttggcagtgacagcagcaactggtttggctgcatcgtacaaaaggagatcctgtgatgcttttacaatatctttccgataacacacagtatgtggccactccctcatccagctgtggtcacctggttctgttttaactttgcacacctcagttagccacagaaagtccattttgtctgtaggcgggcggacgggggcgcacttcagcaccacgcacccgattgtactctatgcaaccggccacaaagccggaggggtgtttgagtcctaatttgcccttttgtggagcctttccataatggaatttgttactgttagctcttctcctataagataaacagcatacttgaatgggggaggggtgctagagcaaggagtttaaagaagtcttggaaaatatcaaccctttgttccttcgctaacttgtgcttatagcgtggaaaatcttactttccagattgcaaaacagacagcttgctaaggctcaggtgcttttcatgagaaatctttgctacatcagttttcctcatgcactcttcagtttattggcagaacttgactcttggtgtgaccctttcgtatggctttggcctgcccttgccttccacacctctctcaaaaccaccgtattaaagattctgctgcaatttccagcctttccttcttgaaactctcgcctccattttcttccacaatacctctgagactctcagtcaggtctgtgtatacaatggaaggaccgaaattttcttagttttgattggttgatgcagctgagttctgattggtcaatatctgtttctctgcttcttcttcctgtttctttatttgtcctctgagagatggacttctccagaagaatagcctcgtgccctggtaatcctcctcctctaggctcatctcatatatgtccattgtgcttacccgataaattggtcacctcaaacatattcccaacagtccccctgagcttcagccctcccctgcatctctgggttccttcacctgttgcatcctttcacctagccattcagttggcaaatcaaattcagtgccaccaagtcaactcatggtcttcacccctcaaatcttcctttctgtgtttcttagttctgtgagtggtacccactatctactatttcccaaagccaattacctaattaaaacacatatcaagggttagtcatctccgggtaagctgtctgaaaatgtgcatgtttgtaaggggcagagaggaagacactcttcctgtcctcaaggagctcacagtctagcagagatggcagacatggcagcccatgcggacagaacaccaggaccagcctggtggactggtacatggccaaggctgaggaggcaaggtggaagggcaatcatatactctgtctgggcaaggcctctttaaggagagaatggcaccccacatgaagtaggagtttcgtagctgttggttgagttgaagtttgcaaactcaacttccagcgttggtccaggctctgtaagatttagaggtgcaccctccaaagcacaggtgccagtgatgggcgagaggtttcttggccacttcctcaaggtaaaggattactgaagagaccagggcatttggatttggctcaccaagaaaggaaagagctcagaaaggaggaaaaagaagagccagtttctcttctgaattgcttccctcttagtctggagccccatatcctgcttcaggtgaagaatgagggcttttgtgtgtgtatgtgtgtgtgcgcttttgattttttaaactacagagctactcagagatgtaggggccaaatttgttgaccacttctggcaacctactgacccctttgaaatgggcatttccatgagtgcacctttcccaaacttttgagtttattaactctagaggaaaatgactcctcttctccagcttttccaagagaagcctctggagtacatgaagaccaagcctctcattttacagatgaggacactgaggcccattgacctggtgtcccttgctcggagcagcatgcaagcagtgatcagacaatgctggggctcagaagtcatccccctcagtctcccatctggatcagcttttcaaggctgggcaagtgactctgccttgtctgtgtgcttggcactgcacctctgtctgggactggggtccccaataggataggaccctcctgtccagtccagccagatggcgagctgggaagttacttaaagaaactaaaacctgagacaaagagtggtaaggtctgagagaaaatcagcatgtgtgatttgtgcctggaagggggaaccacttcttgtaggggaaacttctgcacttctctctctataggccccatatagtaaacccttaccattaactcaatgcgggctgagcaagagacatgtatgatccttctaccactcctgtaaaacatgggctgcttttgctttacagaagaggaaactgaggcacagagtggagccatgaatttggtgagttgcagagcggaggctcagacctccaccccattcctcctggctcgggagctgtgttcctgggccccctggacagtggtagcgctgaaaggacctggcgtctcacacttcttatcttcattccaattccctttttctcaagaaaattcccactcatcctcccagttcaccctttcctttctgtctttaagtggcttcaagcgacaaagtggctggctcctctgtttctctttcccttttatgcctattgcaagaagctgtaataatcaaagacggccaaaactttctttgaactgggtctttgtggcctttttgcagtcttcagacctcatggtttctcagtggcagttcatcccagcagcttctcctttctctgcctgtgacttctgccgcacttgcgggtgctaccatacactgccggtggtgttggtcccatggtgacacagcgcttggcaatttacacaatgctttcagctctaccctactgaaacgggaaaagttcccttatccccctcgcagggcgtgcaacaggggtgtgactcacttcttcggtgccctgctgctcacacccctcagggggagcctgcaggacaagttgtggcagcattttgggctctgaccctgtggcagcatctagggttgagtgtttacagctccggaagccccagtgagtgtgtgatacagggtgctctttcagttttgccgtctgcaggtggcctgtgttaatcaactcaattagaccctctgccttattgcaaggacagagggctttctctatcccaggttcttgcctcagtgtatcagaaaaattggatcacatgtgggcttggaggatgggtgcaaggttttattgagtggagctagctctcagtgaggtggatggggggccagaagggggacggagtgggaaggtggtcttctcctggagtcgggctgtccagcggctgggctctcccctgactgcccccagctgaattccatgtcacccgccatccattgcctgccggcatctgccggtgcctgtcggtgtgctcttcctgtcatttgctcctctcaacgtccagctgcctgtgtctgggtccactagggtctcggggtttttgtaggcacgggatgggggtgtgtggtgggccagagtgatcttggaaaacgcaacatttgagctcgaaaacaggagtgcctgtcctcacttaggtacgtgggcacaggcctgagggtggagccctcgccagggaccccagccttctttacccagcacttccctgtcctcctcccgtgtcactgtcacaggtgagctccctgtctcggagtgcctcttcttggttacaccatgtaggtcgcgtccctaccaagggatcctgctttcctgttctccgttgattggacacgggttggacatttgatcctgggttggggtaaggaatctattggatggccacagctgtgccattcctcattgaagagtttgagagactgtggttagactgctgtgctctgtcgtctgctagggcagaggtgacctccccaagattgcaaatgtggagaaaagagccttgaaaagttacaaatcctctgagaagaaggaaatgaagctctggacaaaggggacccgagagaagacctgcaggcccagagaggcagaggagagagagatggagagtctgtgactgcctttccagtttctgttctctgttctgtgatagtctactttctgcagaaaagaaagccttcttttgagaattctagtctggctgattttctgttttctttttatacaattgcacgaaggctccccaagtcgtcaagtttcccttgcttggcatgttatcctcatacacagaatcctctctgtgtgctagtgggattgcccatcccagatcctaaggcattcatagtcccggcagggacctccctgcagagagctcctttgcctactagcacccagtttcatttgagaaacatcatcagctgacagatcctttgcgtgaccattgcaagctgtgaagaggaggcagtgctgtctcagatggggtcttcttcctgtttctccttccttctagaaagatgaggcatatgtgtaagactgcagtcagcaggggccaccagagaatcttccacttgaatggccggtgatgctttcccaaagtttgtgctgctgagcaggaggaggcctggtttgctgggcagagagggtggcaagaacaggaactaacagagagggtggcaacaacagaacagttgcagatccaggagctgggatcaagaggctcctgtgggggctgtttccaatcattggggaatgaatgtggggagggagatggcttcccaaatcagatacactacatttctcataagagcagcttgtaaggctttgtcccatgttcaggggcggctgcgaaggcctcttgggtggcagcctcattgtgactgatggctgcatgtggggagagaaggggagactggccttggcatccaggctgtggaaggggaagggaggagagagctgtttctggaattggagtgaggaggaaggtagaggaagaaagccatacggtttggagggcctagggctccttgaaaaggacttctaggccagccccagcagggacttgtggagtaggattacagaacatgtatgtgtcctggtgaggagggcagaagcctgaagcttcccggaggcttagagggagcacagcaagaggaatcctgaaatgagagtggaagaactggggactgtgaggccagagaaggcacgcagggagctgggtctttgaactttctagttctagtgtcaggattctgaaatacagtaaggttggactcacatctttattacttgggcctaattaagaaaaaagaaaaagcaacaaaagaaaatggcagaaaacatttatgaccttcaaggatctgtgatgcctgccctgacacacacccttgaaccctgggcaggaaccatcactcgtacatcacaatgacttggatttgatatcttcaaattttaatccaagcaaagccatgaaagcctttgctttcttaaaagaggccgacttttccctagttccatttgaatttactttttaagccctcttttcagagctagaaataaatttcttgtaaatttctgcataaacacgcctgtccccatttcaacagggttctgtagttgacagtgctttagtgaactagttctcacaaaacatgtgcaacgcaaacttcatttcgttccagtcctttgtgcaaaaagataattgccagttgtatgctgtttgttttgtattctcagaaaagaaaaagggaaccaaagggaaacttttcaaatatttttcactgttaaatctaaattccctatctctcttttaaaaaaaaatctatataaatacatggggtacaagcgtaattttgttacactcatagattgtgtagtggtgaagtcagggcttctgggatatgcctcacccaaataacatacatggtgcccattaagtagaaattctctctttattgaaaatattctaatcagccaaaactttaagacttgtgtataaacatttgtgtagctcataacaaatagcaaagaaatttaggaaaggaatcataattcctaaaacctcaccgccgttccctctgggtggcagtttctttaaactaccctctaactctatgagggaaagtattgcctacctggcttgggttggccgctaccagatggatagattttctgtgcctgcctcttcacaatgagatttgtgaactacttgggggcagggactgttctcagacccacttctcatctctgtacctggcccataatgagtactcaatagatgttggtggaatgaaactgctttgtaaatcctacaagttttaggtttgaagctctgatttcttgcttcagagcatagacattttaaattatgacgttctggtgtgaagaacagcatctggccctggccatcaggcacgccactgacaaacctccacgttggaagaaacgcccatggaaggaggccaggccgagctcccacagggaagcaatctcagagtctgggtgttggactagaggggaacccagagatcatccagcactgccccttcaaatcctctaatttaccttgaaagaaaagaatttctgtgattttcagatatactttttttccccgaagatactctggaaaaaataaaaccttgaatataacctggagctttttgtaccctacgactgaaaaatgactcagagaaagaccccggctggagagttccttctttctcacactctttgtggtacacgtatggcttcattgcctcccttacttcagggaatgaaaagagagatgggatctctgtgcatgtgtcatcaggtccttaggggaccagtagattccttcctttagcttctctgcagataaaaccaatccttagagacccgaagcagagctctttggagaaagcagcaggggctccttcctggaagtgccccatgggatcctccctggaaagaacccagagtgcaaaggctgcgagccgtgcccctcccggggcaggctgggaggcctcaagctgagtgctgatttgctgctgacaccagcagcggcttctgctgcttactttgaggccttctggaaatttgcttggaaatacttctgtaaagctctccctcccaggggcagaaggaaggctctcactgtggagtgttatgtgctgagatgttacaggtgagacactcagcatcagaccacagcagctcaggcttgacaaaaggaccaacatatcatcaaagtcaacttcacaggaaaagattcagagggccctcccatcccatgatattttgctctagaaagagcaggtcacgaatgacagagcaggggttgggtgcatcagccctaggggttttgaactcatccaaaaagggtaacttcttccaggccatttcattctgcctctacttccccataccattcctgccccacctgcaactgccaaatagcggctccatcaatgacctggttcctgggatgccctggaccgggagattgtttcagagttgggtggtcagggagccatgatgggcccagaaagacagtagagagccaggactagccagcagagtggggctgacttcctgggagagtagaggctggcagggcctctggggaggggtggtgatgttggcattagagcaaatcacgccagtggatcagctctgggaagggtgaatgaggccttgtttgtgcgcctgaaatatcaaagccaaggatggagaagttctttttgattccatcacccttaaggcagaaagggaccactgataagccacaagcaatcttcacacatctcctgtggtttgtctgtgtccccgcccacatctcatcttgaattgtaatccccataatcaccatgtgttgtgggagggatccggcgggaggtaattgaatgaagggggctgcttcccccatactgttcttgtgatggtgagtgagttctcacaagatctgatggttttataagcatctggcatttcccctgctggtactcgttctctctcctgctgtcctgtgaagaggtccttctgccatgattgttaagtttcttgtggccgcccccccgccacagccatgcggaactgtgagtcaattaaacctcttttctttataaattacccagtctcaggtattccttcttagcagcgtgagaagggagtaatataccatctctctgctagaacatgtctggaagggagataaagatatttatgtgttcagttttacaattatattgtttgtgcacacacacacacacacatacatatacctaggataaggttctcgtacttttcaaaatttaaaatggtacctattccatagactatgcttagaaaacaagtgcttgatttactaaactaagcccagggaaggttttaacaattgatagtggtaagtaagtgcccttgtcccttactaattctaaattttacctacttgtctgacaagcagtttgaattgtctgaaggccctttgtgaattcccaaaactgggcatgtgtttggttgtttgtggttgacagtgtgaggagtaaaaaaggtttccctagagcgtctgtggggtttctttcaatatgacatgtagaagaatgtagcatttagatgtgagaaattactcaaaacagactccattcataactaaaatgcttgttgtgccctgggttgcgcgcgcgcgcgcacacacacacacacacacacacacacacacacacgtgttttgaaagaagagtgggaaggaagcagaaaattaagaatagcctttaagaagacacaggtggctccaggcgggaagtgctgctgctgtgatgcccccggaaatgctgtcctgccaacactgagggtcttttgggccagtgggcctcatggggtcctctgcctggcagggggaaggtgggcaaaggctggtgcccaggtctgtgcaggctactgtgcttgttttggggagaggggccgtgccagctccacccgggagcaggatccacccttctgtttctttgccacgtgcaggcttctccctgcccattctcttctcagcagagctgccacatggatcctgggctcatcctccattagcccttcaatcttgtaaatgacaaggaaaagagaataggtgggtggaaatgagattcagagaggacagctatggagagggatgtggcctcagccctgtgcacacctagcctgtcctccctgaggctctgctgggagcaaaacctccctacacagcagagcagccagactcctggaagtctccacagagcgtggttgcaggtgcagaggggcccctcaaatcagttcaaattctatatattttaaaacaaggcagagaacattgtcacactgcagcagcatcacagctgagtccagttcattttggtctcccatccaagtactaaccaggcccaaccctgcttagcttctgagatcagatgagagatcaccatgaaccctcttagagggatcccacaagaagttcctgggttgagaggatctatgacctagaagcttgatgcatgcatgattcatggaatcttcatttccttgggatagtgttgcttctagtgggtgcaggctggaggaagagagttgagtgttaagagggaaagaagtgcagctggctggatttaggtgaggctgtcagaagctcagaggagagggacagtgatatgcctcacactgggctgcgtgaggccaggggcaggggaaccactggagagcttgtcatggcggaagttggagccgggctttcctgagacgctctggcaggtgacagggttggaggcattttgagggggggggtgtgtgagtagactggtaagtgggagccagcgggggggacccaggggtaggagcagcttgttcacaagctgacatgtctgtacttcttggattctcttttccaaaccattggtaatcccctctcctccctttcgaacccattttgatatggcttgaatagtgttctcacgttctgttctgtagtctggagtggctagagcatcagttctgtgatacatctgacaattctgccttctagatacatttcaccatcattttttcaagttctataatgtacatgtgcattaatcagtattgcatatccaaatactccttgggtgactttatatcattatcatttacttcatgacctctccaattattcttttatttttccttctatgattttgataatttccgtgctttaagtaaatcacttcagtctgaagattggtaaattatctagtatttaatagccttagttgcaaactcagggtggaacccttttgatatattatccaactacttcataagcatacaggcatggattttggggggctaatttatctgactttcattttcttatcaaatagtggttccaaacattgttatttagagagaagcatgttgtgagacaagctagaaagtggtttctagtctctattctgtctctcccttttgacaagccatgtaaccattgtaagccttagctcttctacaaaaggaggtaatattcatctcttttacatccatatgtagatttggttaggagaattgtgcacacatacacatacatacacaacaaaactgtgttaatgtctgtcattggtgcaaccacaatttaacctttagtaagtttctgtgcctgagatgcctgatatttttttctgtataattaattcagagggaaagagtgcagattcttcaacagtgctggattatagcacatgatcccctaagtgcatggtcctgcctatgaattcacatatgctcgtctttttctcctgtatttggcccctgctttggccttgccattggctacttgtgcctttgccttcagcatcaagaccagaacaattcaacatcaacttcaaaaataaatactggacgtgacctccaagagcatgcacggtttggctcatgcctgcccattggcctgttggctgttggcatctcgaatatgccacactccttccttctcagcactgaggcattgctcatgcagttccttctacctagaatgcctttgcccttactcctcatcctccccattttcaactaggtaattactcttgtatgtctttcagatttcagctccattgttcatagaggagccctaaactagatcagggctttaagctctcacagtgtatgcactgtctctttataacgcctgtcacagataagtattctaggattatctgcacttctcatcgggcatgaactgtccttcttcttgctgctatattcctaacatccagctcacaggtgttcaataagtatttgttgaatgaatgagtgaatgagtgcgtttagtttttgaaacttgttctagtgtgtgcaccaagactttttgttgtcgtaatacccaatgaacacacagagacagccatgactcctgccccttgagccaacgagcctgtttactcggtggcggggaaggtggctgggctgctcttctccaggctggatgccccccaaaagacccatagtgtgattagtttgccttctggttccttggtccctttgggttcttagccccttgggtgccccaggccttcatcttttctttcatatctttagcaggcctctgtgccccacatcacttttcttctctttccccagcagtcttgcctggccctgtctccctctccaagcccctctttccagtgtatctgtacccgtctctggactgtgaatcctgccctgccctgaacctttccttaactgttggcttcaactgccatcagaatgttccaccctcaaaattctcaggggttggtgccctggttctttggctgggtggactacaaggccccgaggactgggtccagcctttacttctgagtggtctcagccttcagcacccagtaaccacacagcagtgcatggcgacttgattttcccgcctaaatcttaaccaagtttccaaggccatcgtggtcacttgtgtgacccctctgctgcagcttcacaatttcaccacactcatctgctttggttgaggagaaacttctgtggatacattggcaggcctagctggggaaagttggggaccacaggacttcctgctaccttacttggctcaaccccctaggacactcctgacctgaagcggcagctgtcccctgtcacccctaacattgcataccccaaagtagctcacactccaaggctgcaaatgcttgtgttcttccactctcagggctggggctaggccatggaggaggaggaaaggccattctagtggctcaaagagccagtgcaaaagcattgcttatggtggcttcttcaggggttgcagatgtgtatagctctaagaaatataaactcatgccccccaacaatgcctcatgcttaaccagctctctttctggcctcatgtgtctactgggaaaattgaggcctcctctctgatttgattgtgtcttacttacaggtgtttagtacctgggagtgagaggcccatctaatcagagctggccttgggctctgcagcttaccctggtcactcttggtactcctggaacaaggaatactttatacttttctcattcatttattcattcagtcatccagtcattcatttaacagttgttgaacacctatgtgccaggcattagctatgtactggggatacaaaaagtgttaggcaaacagaaacagacattcaccctcagagagcttctgccctgacaaactttgtatatgaagagagtaagttttgtagagcagttggctggagtgaggtgtgtgagataatagtgcaagctgaggccaggaaaggaggccgagatgctatgagaacttgctataagaacttgcagaccaggttcaaaatttcagcttttatcctagaagccttgggaagcctttgaatgaagggtcttaagcagaggagataaatgatcacattttttttttccttttaagtgaggacacctgcgccgtgtggcacacaacttagaagaaggcaaaagtggagattggtcagaaggcccactgggaaagggagagccttggaggggtgaaaggatttgacatgtaacccagttgaggaaaactgacaggctgtgaggtcagggatctctgctcattgtgaaagcaaacacagagggagataattgtaacttgaatttgaggcaggttgaggtggctttgtaagaggcaggcaaggctaggacaagtgacaggagtgagggactggagctccggaaaggtagtgcctggtcagggctgcaggatggccgttcccgaagcaggagggctccaagggagtctccaaagcctgctcatcctggtcttttcagagctgctctgagcatccaagaggtccagagaaaaggtgccgtggagacacacacaggctgacagaagctgggaagggtcagcgtggaccacaagtgaagacgaccttagcagatggaggcagtctgtcagatcccctccaccaccccctgggccagtgtgccgcagctgggggcaggccagcccctctatcacttactatggctgccgttttgtgcctggccatccatcatagacaaccttcaactggaatctctcctaatgaagccctaccacacagaggcagtcagccctgcaacggtgtaggctcgaggccatggccgcagcaggaggcagtggcagtagagggtggcagttagggggcaggaatcactggactctcagaaccccattggggtgtggcttcctcaagccctccaaggcaagacatacactgggacaaataaataagttttcagggccaggtgcggtggctcacgcatgtaatcgcagccactgtgggaggcctaggcgggaggatcatctgaggtcaggagtttgagaccagcctggccaacatggtaaaaccccgtccttactaaaaaaatacagaaactagctgggcgtggtggtggttgtggtgctagtagctgtaatcccagctacttgggaggctgaggcaggagaaacacttgaacctgggaggcagaggttgcaatgagccaagattgctccattgcactccagcctgggcaacaagagtgaaactccatctcaaagaaaacaaaagaaaagaaataggttttcagcaggagacagcaggcacatcgatggcaccagaggaagatgccgtgaccttgaaggatcattgttggagtggttatcccaaggatggggccagtgctgcacctcctgccctcaatttctccatttataaaatggagataatacagtcatccctacctcacagagttgtcatgagggttttatatattagttgatatatttaataactagagcagccagacacatcccaaatgctagtcagtattatcatgatttcatcaggcattgcccatttacatgaaatgcttggactctggtggcataaaccctgttattattgatgtgattccatctgctcaaaaagtgcacatttcaggttaaagattgaatggtaatgataagattcagttttaggattacatagtaggacagtttggagaaatcgtttcccaacatgcttattaaagtggaaaggatagggaattcagaatcagaaggccatggatatttattggagtatccttcatattctggagccagtgctaggggccagaaattcaatggccagcatgatagagatggcacccgcactgatggagctgctgactctgctggggagacagacaaaaagagttaaaaatgattacaaattatgattaatgctaggaaggaaaaaaatccaataggaataacaggatatgagtttcctactttgggtcatgaaaattttctcacttatggtgacacgaagctgagtgttgctactcaaaggcaggagttgaggtatttgggaggtagaggggagagttctgagcagcaaatggttttcttgcccagttaggtgatcttaggctccgtgatctacattagtctcagtttctacatttgtaaaatggggataatcttatctacccagatgaccacgcagagctggtatgagggtgaagtgaagcgatatgaattttgttaaccatagatgagtgccctaaccctaagtcctaatgaggacttccaaacgaggaaagaattcactgatattcttctcgcatttttttctatcctccaaattttgttcacatgtataacatgactgtcacacagtggctgaaggtcgtgttgagaagaaatgacccttgtaaaccaagagtatttgagacagaactcagtcaatttagaaagtctgttttgccaaggttaagaatgcgcccatgaggcagccttaggaggtcctggagacacgtgctcatggtggtcagtacagtttggttttatacattttaggggaacatgagacatcaatcaatatatgtaagatgtacattggtttggtccagaagcaccctggagttgagaatagcagtgctaatgcgatgaggttactgaagggagacaaagatgattccctggatgacagatgtctgagctgagtcttagaagatgagaaggagattacaggtttttgtaaagctgaaaagccagagaaaattttaatgtggagtacgtggtgcatagttaaatgttcagtagataccttccccttctaaaacttgttctggaagaaggtcatagttaacgttacttaatgttcaccaatctcccatgaagttctggaaacagagaggaagacatgcttttccctgggtgctcaggaatgggacttccatccattagctcatccacacatgcgtgatgaactgaaggacactccaaagataggaagcatctaagggaaggactgcccggtgatctttttgctgtaaaggaatatgtggggttaggattaagactcggcaggtttgcaaaaacatctcatttcacacatgtgaggaaacaagacaagtgataacatgaatgaatttaggaactgccctcctccgggaagaagaccagtcctcccgggctggacagtggagcatcagccacggctatgcttcttctgtttgatgtggccctcatggacagtgccatgctgctgattacatcacaagttcactgcaaacccaggtgaccatctggcctgtgcctacagcttctgaatggggctctctgtgtgagtgttactgtattggtgattttgagaatattgagggagaaagagacatcacttggttggtgaagaagttgcccagagctggacgtagccaggtcaagttctgataaagacactttctcagcgcttcaccctgaaagactgaagcgctgaagcaagcactttcacagggcacctctcaggcagccttcaggtgagagggagagagaaggacccttctgaagggaacgaggagggcagagagctagggagggaaggtcagaaggagaagggcctgaccttgagatgccatgggctttaggctttctgtgcctgtttgaggctatttccctgctgagtctgagtcccatgttcaaggtcactttcatggagtctatggaaaacacctccccaagctaagtgacctctcaaaattttggctttgaagttgtaagagttaatctgcgtgaatgccccagtgtaggtgaagaggagagtcaaaggaagacagctggaaaagaaaggtgtaggaggggcaagagaaaccagtggctctgaacagagaaggggggttgtatcaagacaggtcaagggtcctgtggggcagattcctaaggtcatgaggaaggaagacattgacttgcgctggcaatgacaatcacaaggaagttcagggatcatgcagaggtgaggggtgtgggaagtcaggagactgcttgggcttgtcagggggcaggcatagggatggtagtgggtccagacacgaagggttggcactttctcctttttcacggctctcttttcccactaacagcctcagctcgtggcacagttctggactcagcagggaatgctgttcatggagagtggtaatgcagggacccccacatcttgtggaaggaagacctcacattgcaaagcagtcagttctccccaaatgaacagatacatttaacacaatttccatcaaaatagtgtgaggttttttttttttttcttttggaacttgtagtggtatttctactatttattttgaagaatatattttggatgaacaagtgaaactagcccagagaaaaggaacaataaataaaataaatgggcaaaagcttgtgctgttagctttaaagtgtatttaaaataaatctgaaatcatttaaacagcatgaaccttggtggccaaatagatcaatgacaaagaggagaaaacctagatacaggttcatttttgccttatatgctttgagattagtgtttctatttagagctgtgactaatacagatgcatcacggctgagagcaaagcgaggtgaatgtccctattaattgccaccatggtgcgaggctggaatgagggtgtggccagctaagaggggatttgctcttcttgccctagaagttcctcattgtttcctgtcctgtcttgtgtccagctgcttagcacacttccttttggtatttaatgctttttatagctggaaccctgaggttcctcagaaatctgcacatgcttactagatggtgctctggattttctttaaagataggaagaaaaaggcaaaggcaggtctgtgacgcttcttacctcgagcagagctggtggagtgaatgccatggctccagctgcacccccagctgatgaaaatggccttccatttgctgagattcttcccttttctcccccaacccccatcatcaatatgggcactccgtagactgcaaatgtgagctttcatccttaagtatattgaggcgtgacttttcctaataaaggtggcattccaaatcagtgtaaagcattcagtaattgatacagaaatcacctagtcatttttccccccagagtctgcttgggggcaggccaggtagtgttctggattcaaaaattcaccatgtgaacaacagaaaatgaagtttttttgttcccagggaacagggagctcttagtgaagaagaaacacagtaagtgatgagtcaaccaattaacagcttgacaggaaactggtgagatgaagaaaaatgaatccagctaggacaatagacacggatggaggtgggtggtagtcaaggaagactccttggataagctggtgtttgggcagaggcctgaagaagtgtaagccatgctatgggggtatctgggtaagaacgttccaggaagtggtgggtacagcaagtgcagagatgcaccttgtggattgactccttgaagtgaatcctttttaatacctccttctttacatggcaagattattgttagtgatcatgcaatcaattaccatcttcatttattctttttttaatgagtataaacttgccatttttaattaaagttacttacaattgaattagctaaaaagtctagtgcatttgaaacaaaattgtttataagctagctatgtttacagaatgaaaagtaaaattaaagataaagacattaatattctaaattagcactttccaaactgtgttctaaaaaccaacactcataacacaaggagatgagaataatgtacactggacagcccctgtggggctggtggtggtgttggttgttgttccttttaaaataagcttcatcccagggtgctctcaaggcgcatctttgtggcccatgaggtgctcctgcacaatgggaaaaaatcaaatgcagatacactgtggtgccagaagagaaaaagctgttccttcttccaaggctaatgtccaaagtagtacatattgatttaggtctggaacgcagtgaaaaactaatttttcgtaaaaaacattaaataaaaggaacctatccttctcactgtgttcaacattgtcttaaggtataaaggcatcaaatagctacactttttctgggattgcttatttgctaactgatttttccttccaccacgacgtctaagattaaatgagaaattgatacttaatatttagaatctggatatcaatatgtagttgactccaatttctttttcttttttctttttctttttctttttttttttttttttttttgagacggagcctagctctgtcgcccaggctggagtgcagaggcacgatcttggctcacggcaagctccgcctcccgggttcacgccattctcctgcctcagcctctggaatagctgggactacaggcgcccgccaccacgcccggctaattttttttgtattcttagtagagatggggtttcactgtgttagccaggatggtcttgatctcctgacctcgtgatccgccgcatcggcctcccaaagtgctgggattacaggcatgagccaccgcgcctggccccaatttcttaaactgattgctgaagagggcaaccaaatggctgaaataattttagaataaaggagtgtctcccttggtagtatagttgtactcaaaattttattgtaagatgagtctggccggccgtgctgtcattaaggagcatgaacgttgttgctgaataaaatgctcagtagatacctctgggttgtcagaggggctggactctaatactgtatctccaggcctctgcaggttagggatgtggtgcatgtgtaggtcttctccaacttcaaatttatctgtccttcagctgctgcctcacagatcccaggagggaacaccatcccctgttgctggtccaacttggggctggccatgataaattcattgggctggcagacagtggtagcgactcctcccagggcaatccaggggtttagtatggtttggccacccattacagatgttcctgcttcctcagctgcgtctttaaaaccctggataatcagagacatcattttatccctttccctgtcggtcattttaggactgactccaaggagcatcagcatattgtcacattccgtgacccacattgcgtagaggtcactgaagacactggcacgtgctatcctgcccatcatggaagggtcgtctacgatccggtaaacgtaatctgtagtttgaaccaaggaaagcccaccgtgcctcaaaggaatgacacgagtatccattccaatgccaagccttggcgtaacggctcccagaaactgctcatcttcttggaagtggttctcctataaagattacagcaatttttgcaggacatcttggggcactttgcagcctgtgcccttcagttcagtgaatctggttagccggaagctcttgtccaattcgtaactttcggggttaaaggactcacgcgtagacatggttcttgggtccgctctcctcacagcttgccccctccccaccctctgcgggttggctgggttctttttttttttttttttttaatttattttttttattatactttaagttttagggtacatgcgcacattgtgcgggttagttacatacgtatacatgtgccgtgctggtgtgctgcacccactaactcctcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgagatagtttactgagaatgatgatttccaatttcatccatgtccctacaaaggacatgaactcatcattttttatggctgcatagtattccacagtgtataagtgccacattttcttaatccagtctatcactgttggacatttgggttggttccaagtctttgctattgtgaataatgccgcaataaacatacgtgtgcatgtatctttatagcagcatgatttatagtcctttgggtatatacccagtaatgggatggctgggtcaaatggtatttctacttctagatccctgaggaatcaccacactgacttccacaatggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatacagaatctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaaggcgttggctgggttctttagggattcacccgcttgctttgcgccctccgcctcctcccggaaaatgggccgtgaacggctcccacaatgcaccgggcgctgccggcttcccttaagcattgcctgaataaaaacgccgcggcccgcagtagcggccacagcgaggacgcgggctcacacctgggcgctgctggggctcgtttggctcggcgcgaccctgcggagccgggactctgcgctcccgtcagctgggccgggggctggtttattctttagttttaagacaatttaaagtatatacatttcaatttaaaagataatattcaacttaaggaaaatattgaatacacttcttaagtatgtttttcttttaaaaaacatagctgcagcttaaagaaatatattgtgttcactttttaaattttaaacacaaagtggtaagatagaacaataaaatcgaagtggcttagctcaggctgctataaacagaaacatcatagactgggtggcttaagcaacaggaatttatttcttaccgttctggaggctgggaagtccaagatcacatggtggagagagagagatcatctctgtcatgtctgttgttataaaggtgctaatcttatccatgagacctccaccctcatgacctaatcacttcccaaaggccccctcctgataccatcgctttggggattagggctccaaattttggggggatacgttcagttcataacatgaaataactcaaattctggttttttgactttagaagtcaaagaatcattgtgctatcattctatattttgagtctactgtttaaattcagttaaacttaaggatatgtggcgctacaaggattggagacatgaactgcacccaaagcaagctgaagtgattcggaaccactgtgaactgaaccctcaaaatacgtatagatgagtgaatatttacataggcctaaatgtgcgtgtgtgtgtgtgtgtgcacgcgcatgtgcctgtcttcctgcaaccccccagccccagaaacattcttaggctcagcatttgccagcatacagagtattagattttccttgattgttttgatagctgaaaagtcacattgtcaggtagccccagctcacttcctagtttgtaggttctttgatgctgctgtgagatgttctctcagacatgtatttctgttgctctgattagatgaatgaaaaactacagtcttcatcataaattgctacctgagttttctgtagttttgcgcctcccatggaatgttactgctagggaatctattgccatgtcacattctgcagccacccatttaccctggacccttgtttactggatgcttcagtcctcaaatgaaggtagcaagacgaacagggttatgggttgctaccattgtggccacttcaagggcatcagctacacagtagacaggcggctgtccggtgcccagtgctgtgtttggatggatcccaaccttgattaggtaaggctgtaaagggttagggaggaagcctcttcctacttttgttaaagaaggcaaagcaactttatttcatatagtcaaaaacaatgcaacagctctttttttttttttttttttttttgagatgcagtgttgctttgtcgcccaggctggagtgcagtggcatgatcttggctcactatagccaccactcccgggttcaagcaattctccctgcctcagcctcccgagtagctgggattacaggcgcccaccaccatgcccagctaattttttgtaattttttttggtaaagacagggtttcaccatgttggccaggctggtcttgaactcctgacctcaggtgatccgcctgcctcagcctcccaaagtgctgggattacaggcattagccactgtgaccagccagctctgttcttttttcacgaatttaaccttctaagtagaagtaggaaccttctaagtaggaagacatttctaaatgccacccaatttaccgacagattggttgtcagtcatagtctgtatgtgtctgtttccaactttacctgttttgtaatttactagaaaaatagcagagtataactttgccattttaaacagaaggtcggggtcctaatgaaagcgttttcttggttcaggatttctgtgggtatttctgccagggagaggctagaagcaggagagggtgagagggactttataatctctatatagctttgcagttgttaagatggcacccaggaatgtgctcacccagcttgctcccaggaggtagtatgacttcaacccagtgaaccggtcctttttatggagtggccttcccaaggatgtgatgacgttggtgaccgtacgaatggcaatctgtatctaagacagctatgactgctctattctataatgaatgttgttggcttttaaatgaagcctttataaataaagggtctgtttacttaaaagttaaaggcatgatttaggatgagccaactagactgacagaatttacctcaacctgtaggtggattctcgagttagccggagtgtgtatctggggaaagcagcctagagtttcatgggtctctgaccacagggtatgaagaaaacccaggctatttaaaacatgtgtttgcttctagaaaataaaacagtatttgtagatgttttgaaaacattcccaaggatgacagaggaggagactttggtagtcaacagaggcaaccctcttccagggtcgttgacggagctgcagtgtagtcggcctcagctgaggagcttcactccctccctgccggaaccagccgccacaactggcttctccgtcagccttaggaaaagcagtcttgttgagttctctacagttcttactcacagcctctcatccattgggtgatagaaaaaacaacaacttgggctttgcattgtttacttttacaaatcccaattcagctccatttcgagctgtctagggcagggaagaggcctctgataagcacagctggaacagcaggaaaatattccccaaccctgctgttgacatggcttgctttcttctatcaccaaggggtctctagaaatgatcagagaagtgagaggaaatttgaataccagatatatcttcagaatctccagtcaactctaaagatttgagcggggagagatgaacagcacgatacagaaccaacaagcacacaaaccttccgaaagagacccgaactcgtggcctcttctttacatgtccacctgtccttctctttcacctccttgccaaggtggctgtgtctcattgccaaactgaagacaaaaggaaaatgaaagtatttgggatcagaataattgatcttagattgggaagggtcagcgaaatcctctcatccagtattctgtttttcacagaataatctaagggctacttaaccccatgacagacctgtattttatcagtgatcagttttggtctaaagataatgtataggaaatgtgccttgtggcaaaggatatcggtttattttcttcgtggccagggatatgtggggataggatcagaactttctggatccttaaaaagcattctatataaaaaaattatggaatgaagaaaagttaaaaaagaaactggggtccttgccttctctgtgaatgaatgctcctggctgggcctagagactaatatcatgctgatatcatgcttctgttcatgttagggcccacaaaaccgtgtcctgtgatgggtggggttacaggtccctggagcccaggggcttcagacaactttggcatttgatgggatgtggtcatgaatgttctctgtggccatacaagaggaggaagctaccattgaaaaggaaggtcatctggtgatgaagctgggcattatctcccttcaggagaggctcacaaaatgctgatgggcttcttccatgaagaatgcaggagttccaggggcagggccgcttgacactcttataaatttgaggggaaggggaaaatgttctatgagaatgggagcctaggtgggtggtgcacaaaatggacataattagtaggggaagctcagggggagggttgaagggtggcaggggctgtgggaagaaggcctctggggaggatgtttgtggccattgtattgaaagcccacggtttctcagaacaggcaggtgatcagagcctcagtctgcacatcaaatgtatcacctttgtattagtctgttctcatgctgctaataaagatatactcaacactgggtaatttataaagaaaaagaagtttaatggactcacagttccatgtggctggggaggcttcacaatcatggtggaaggtgaaagacatgtcttacatggcagcaggcaagagagagaatgagagccaagcagaaggggaaataatcctttataaaaccatcagatctcgtgagacttattcagcaccacaagaacagtatgggggaaactgcacccatggttcagttatctcccattgggtccctctcacgacacgtggggattatgggagctacaattcaagatgagatttggggagggacacagccaaaccgtatcagccctcaagaggattacatatcttctagggttcacacacgttccctctaatattcaggagttgccaatgtgatggtattgagaggtgggacactccagatgattaggcatgggggctccttttttctgaatggattaggtgcccttccacagagacttgactaagggagttggtccccttttgcccccttgcccttctgccttctgccatgtgaggacacagcattcctccttcttggaggatgcagcattcaaggtgccatcttggaagcagggagcagccgtcatcagcccagctgctgccctgatccaggacttcccagcccccagaactgtgagaagtaagtttctgttttttataaatgacccagtctcagggattttgttacagcagcacaaaacggactgaagcagtattcatccctcatctaactttctgacctagcctaacaaagttttgaagaggactcttcttatttctggctgaggcatgaagacaataggtgtgacacaccaaagggactgccgtgaacaagttttggggtggtggatcaacaattggtgtctctgaaacctctcatccacgtgaggcatatcaatgagtcaggagagagatttttaatattttttaaattctttttgttttttttttgagacagagtcttgctctctcgcccaggctggaatgcagtggcacaatctcaactcactgcaacctctgcctccaagattcaagcaattctccttcctcagcctcatgagtagctgggattacaggtgtcccccaccatggctggctaatttttgtgtttttagtagagacgaggtttcaccatgttggccaggctggtctccaactcctgacgtcaagtgatctgcccacctcagcctcccaaagtgctgggattacaggtgtgaaccaccgtgcctggcccaggagagagattttgaaggaagtgtttctgaaaagaactttgaggtgaaactttacttatataaagcaaggtgtgtgtgtgtgtgtgtgtgtgtgtgtgtgtgtgtgtgtgtgtggtgttggttcttccttcacttcaagtcaacaaaaccatgtagaaaaccatatatgtcacttttcagtaaggggcatagtgggctggtgcctgactccttgagtgaggggtagaaaatgagctaggcaggtgtggatggacaagctgatggtggcatgggggtggggagggtggggactggtttgcatgaatagcacttggggcaaagaaggtgtttctctggaccgaaagtgggccttgggtgaaacccattgtgaggttatctaggaacttgtcaaggcaaattgaactcagtgaagaaaagctaaagctgttgctggattcttgaggactatagatcaagtaagtggccgtctagtaaagccaagtacgtgaccagataaaagaaagtgagagacccctagtgacagttcagaggaccatggaagtgtcccattagagaaaacaccaggtggaagcatgggccaagctcagtacatgaatccagcttctgacagtgtcaggtaggtaagaattttcttttaatcctcctacttcatccaaccaaccctggaatggccagcactgcttctgcacgcagagggagaggccaacaggaaagaaggaaggtgcagaaaacacactgttttcccgtctgctggttacttcttacagcagacccttgtaaggggtgatggggacaggcgtgactatgaatgcagactgaagtataccttattaaaacacattttagctcccgatatgggattgtttttgtgacaaagggaccacaggactctgtgttacttaagagtgaccacggaagccacgagactgctgtctttccttcatgggaccttgaaaaattacccctcattgaaggactaacgtgagaacaaaatcaagtgactttgtgatggagtccaatatcagttcttcccaaattaacgtacattttaatgacttccggtctagatcctagaactgtgtgtgaacatagaaatgtcatgacaagaaagaagaaacattgtagaaaggaatactaggtttaacttaccattccagagagaaacattctaaacatatacagcaactaaaacagcataatgtcatactactgcaagaatccaaagatggtttggtgaaccaatatggatagtacaggaacagacaataatctgtatgagaatcaagtacataaggataatacaagaaaccagaaacagattgttccatatacagtgctgagacaaatggttaattgttttgaaaaacataaatttaaatctttcataaaataacttccagataattaaatagttaaatgtaaataataaagctataaaatactagaggaagaaaacaggcaaaggcccctcccccaatttgttttcaaaccacttaagccatgatagcagatacaaaggaaaagggtggtaaaattgactttatcaaaatacatttgtcaaacacactacagtcaaaattaagaacacagtgatattttggcttctgccaatatgatgaacaagacccctaaactgactcacttgctaaaaacagttggatgtaccggataaatatatttaaaaaatttctaaacgaatatgagacaagatattaaagaacagtaaggcaaaaataaaaatgaaagcagagtctctgagaagtagaactcattatctggctttggacttgaggtatttggttaggtccttgcttgcctggtcttaaatgttatggggtggcattcaatgcccagcatccatgtaaggtggagattggaataggacatccactttataaaactgggactctagcgagctacatcagtttaagggtggagtggaagacacccactttcacacctgcaggggactgcaaagataactgtcaggcttaagacttggaattgaattgaggagatgggaatattccctggtaaattgccacaaactagcccttttctttgtttactgctgtcaaacctgccatctgggaggtctacaaaaatctcaatttgagattgaaatgactgaggactggtagtttccgtcaatgtcttccagaagcaaaaactgattccaattagaagaatttatcttcattctcaaagttccagataaaaaggagcacttcatagtaaaacacacacacatacacacacacagacatacacaaaatatataggtacaaacaaaataacacacaaataacaaggtactttgagtgaaggtcagcaaacagagaaacatcagatccttgaagacttcaaatattaacattttcagacacagaaaataatctgttaaatttcaaaatgtaaaagaacaacctgaaactgattgaagaacaggaagatttgtaaaaagaatcaaacagatattccagaaattaaaaatgattgacatgtaaaactcaacgatgacatatttctacttttgatcaaaatttagtgacaggggccagatttttctacttttgctttcaaaaactagaaaatcaggcaaagcacctgaaacaacagtttttagacattggatacttggtagacaagaagtgtgataagcaagagaagtcaagtcagccctatgatggcaccagcttgcatcctagaggcaaatttcaggatacaagttagggaggagaggctgaaactaaggctagtgcccttactgggttgaggaggcagtgctcagatgtagaggaggccaaatagaatgtagcaggtcctcaaataacgtcatttcattataacacgaatgaggaaaaaaatatcgattcctcactggggccaccgtctgtgtgaagtttgcatgatctcatgtctgtgttttcctctgggtactctgatttcctcccacatcccaaagatgtgcacactaggttgatcggcatgtctaaattctcccagtccaagtgagtgtgagtgtgtgtgtgagtgtgccctgtgatgaaatggcatcctatccagggttgggtctcaccttgtgccctgggctgctgggatagggtccagccacctgagatcctgaactgaataagtgggtaaagaattatctggcttatttttattaatctgtgttaaatgtctgtacagctcacagttatttcaatatttaacattagaagtgttttggtctttatgtagaagtttggtgatgtttatgtgaccagaaatatgccatagaaacttatttcttgtttatgtcaattagcctatggtaaaattggtttcattatatgttgttttgctcaaagtggcaatttctaagaacttgtcaatgatattcagtgagaactgagtgtatatgggacagaataccagagaagaagaaggaacagctataaaaagagctctggagatttgcagagggctccctatggatgtttgactaggtattgatctgtgcatgattgaaaaaaaaaaaaaaaaactaccaatggccaaggaagaactactagaactactggaatggaaacagcagaataattcccagagctcagcagggattgggataatttagctaccactgaccagagtcgaaagccctcataagacatgagacatccaatagaatcctcaaaagggtatccccttaataatgattctaagttagttctggactaaaggctattctgactcttctctgacaaagtgtaaaagcaaaacttgaaaggatctaactgacttaaagtaacctaactgtgagccagaataaattgcacactgtttaaagaaaacaaaatcgaacacccaacaatttaaattttacaatgtctggcatccagtcaaaaattaccaggcatgaaagaagcagaaaaataaggtccataacccaaataaaaatcattaaatagaaacacatccccaaatgacagaggtggtagaaatagcaaacaaggacatgaacacaggtatactctgtgtgttaagaatgtagaagaaaacatgagcagattgaggagagaaatagaaaatataagaatgaattatattccttttggttaaaaaaaagaaaactgaaaggaaaaataatacactgaatgagatgacaggttaaacactacagaagaaaagaagaatgaacctgaatatatagcatcagaaacttctcaaagtaaatagcccgacagaggggaaaaggcagtctaaaatataactggagggccagaaagagaggtcaggaagggggataaactttaacaaggtaatatttctcactgttaattgcttaaagaaaaataagtaacaatgtatttattgttatgtctctagagtatgtcaaagttaaagacgtgatcaagttaaagatgtggccataacagcatagcgtagaggacagatgaagaaaacgcattgtgttgtaaggcttttacatgataagtgatgtgttataatgttatgtaaagataatcagtgataagtgaaagatggatactctaagctctaaagcaaccaaaaaagtaaaccaaggaggcaaaactaataagcccaaagtgaagataaaatgaaatgaaacatttaaggcaaaaggcaaaaaggaaacaaactgcagacagaataaatatataatgaacagcaagataaatgttttaaatctaacatattaatatatgagatggaaatgatgtaaacacaccaatcaaaagacagatagtcaatttggattaacaaaagtaatgcacaactatatgctgtctgagagaaacacacaataaatctgatacaattagtttaaaataattgaaagatatattctgtgcgatcaaactagttggactggatatgtttatatcaaagtagaatttagaacaaagaatattaccaggaataaaaagggccatttcatattgaataagtggtcatctcatcagatgatataacagccacaaatgtctgtgttcctaagaacagagcttcacagtaaatagagcagaaacgattacatccaaaaggagaaatagacagatccacggtcattgttggagatctcaaccctactctcgcaataattgaatgaacaagtagacaggaaatcagtaaggatgtagaagactttaccagctgtagcaactaatttataaatgcctcaactagacattttataaatcacaaaaaccagaaagatacacattcattccaagtgtacaaggaacatttatgaatatctaccataatactgaattaaacaagtctcaacaaacataagatattaaaatcatacaaagtatattctttgtctgcaaaacatgaaactagaagtaaaccaaaagatgtctgaaaaaaatttccaaaccaaggagcaaatcataggcaaatttgaaaagttttgaactgaatggaaaaacatatcaaaatttagggcatagttactgttgagaactgaattgcatctccccaaattctgatgttgaagtcctgactcctggtacttcagaatgttactgtatttggagctgtacctttaaaagggtaattaaattagaatgaggtgattagggtgagccctaatccaataggactggaatccttataagaagagaagattgggacacagaagcacacagagggaagattctgtgaagacacatggagaagacagctatcgaccaggcaagcagagagacctgagacaaaaccaaccctgctgacattttgttcttgaactgctaacctccagaattgtgagaaaatacatttttgttgttgaagttacccagtttatgctactttgtaatggtagacctaacaaactaataacagtatatacattagaaaaacaatgatggatattaaatcaaaggtataagtttttgcttaaaaaatagaaacagaagaacaaaactcaaagcaagtagaagaaagaaactattaaagataaaagcagaattctatagaacagataacagaataacagagaaaactaaatgaaacccaaatctggttctattaaaaggcaaatataatggacaagtgtgaaaattaataaaatccaaaccggctctttgaaatgaataatgacactgataaaactctagctaaacttaataaaagacaaaaattaaaaccagtaataacagaacagatactacaaatagatactacaaatagtaaaaggatagtaaagtagtaagtatgaacaacttcatgctaatatattaccttagatgaaatgaacaaattcttaggaagacacgaactaccagagctcacgcaagaagaaacataacctgaattaaccatatatatgtacttaatttgaattcatagttaaaattttctcacatagaaaattctaggcccagatgatttctctgattagtaaatattttaaaaataccaattctgtacaaatctttacagataatagaagaggaaacacttcctgactccttttatgaggcaagcattaccctgatggtaaaaaaacaaacaagaacaaaaacaaacgtattacaagaaagtaaactacagactaatgtacctaataaatacagatgcaaatatccttaacaaattttagcaaatccaatccaatgatatacaagcagaataatataccatgactaaacagagttcacacagaaaatcatggttggtttactactcaaaaacattacagttcattatattaacagacaaagagtcgtttcaatagacactaaaattttattgataaaattaaacatatattcatgataaaaattctcaggaaactggtagtagaagagaatttcctcaacatgataaagggcatctataataaaaatcctacaactaacatcatacctaatagtgacagggagattggtaagtgtattcattctcattatgacttttattcagcgttattctggaagtcctattcagtgcagaaagcaagaaaaagaaaaggcatacgggttgaaagtaatgaaaagaactctttatccacagacgacataattgttaatgtagaaaatcttagggaatttacaaagaaattactagaatcaataagtgtgtttacgaaattttcttaaaactaagacaacatataaaattaaattttatttctacatgctagcaacacacaatcagaagtggaaatttaaaaagttaaaatagtgtcaaaatactaactacctagaagtgaagttttaaaaacatacgcaatacctgtatgctgaaaataacaaaatattaccaagagaaatgaaaggagaatgaaataaatgcaaagacagaccatgttcatagacggcggactcaatattattaagatataaattttacaaaatttgatctttatgttattgcaaccctaatcaaaacctgcaaacttttgacaacaacaaaaggaaatggaaaaaataattctaaagtttgtatggaaattaaaaacacttaaaatagacaaaacagttttgaaaaaaagaaaaaaactggaaagactttcacaatctaattaaagacttattataaatctttaatagttaatacattgtaattttggcataaggataaacatatagatcaataaaacacaatagagaatttagaaattgactcacttgcatttggccagttcatatttttacaaagatgccaagataatttaatggagaaaggaccaattttccaacaactcttactttaatcatgggatttctaggtgtaaaaaagtgagtcttggttcttaccacacattatatataaaacgaactcaaaataaaaaacatctaaatttaagaggtaaaactacaaaacttctagaaaaaaacatagaagatttttgtatgtatgcgtgggtgtggcctggcttaagtaaagatttcatggtttagacacaaaaaacagaaccataaaagaaaaactgaaaatttacactccatcaaaattaaaaacttttgtttctaaatagacacaggcaagggaaaaggtaagaaatagactgggagaaaataaacgcaaagaagatacctgataaagtcatcgtatctagaatatatagcattgccatccaataataagacaaacaatcagatttaaaaatggacaaaagttttgaatacatatttcaccaaagaagatgtacagttggtgaataagcacatgaaaagatactcaacatcattaacattagagaactgcaaaaccaaaccataaggagaaatataattgcacatttgttagaatgggtaaaattaaaatgattgattatagcaatgttggtgaggatatatagcaactgaaattcttatacatgactggtgagaatgcaaaatggtacagacactttggaaaacagattatttactcaacagaaattaaaatgtggatttacacaaacacttgtactcaaatgttcatagtagctgttttcattatagctaaaacctacaagcaacccaaatgtccatcaactggtgaatgaataaatatattgcagtataaccataaatggaatattcctcatcacccggaaggaggaactactaataccaaataacatgggtgaatctcaaaagcattttgctaagtaaaacaatatgaacacaaaagaatatatagtgtatgatttgctatatgtgaaattctggtaaaggcaaaattagtgacagaaagcaggtcagtgatttttaagggttgggggtgaagtaggggattaattgcaaagggccacagtgggactttttggtggttatagacatattctatctcatgattgaggttatggttacacaactgtgtacattcgtcaaaacttgttgaaacatacacataaaattggtgagtcttattgtgtgtaaattatacctcactgatgctaattaaaaattttataggttaaatagcatcaaacttatctgaaggaataatttggtgcactagagcattgatctaaataaattacccagaacagttcaagaaaggagatttttttaaaaaagagagattaacatatatctcttatgtgtatatatgtatatatacacacaaatacacacataggatagaaattttccagtatgtgtctcattcattcacgtttcagaaggagaaaagacaaaaattaggggagtggtgatatttgaataccaaattgttgataatgtttgaaaactgaaagacatctatccccagacttgagaagccaaatgaatgctgagcataagaaaataaatccacacctaaaaaatcttagcaaaatgaaatattaacaaagataagagatcttaagcatgtgatggtggctcgtgccagtaatcccagttctttgggagtctgaggcttcagtccaggagttagagaccagcctgagcaatatagaccctgtctctacaaaaaattaaaaaaattagctaggtgcggtggcacacttctgtagtccgttagcctcaggaggctgaggtgggagtattgcttgagcccaggaatttgagattgtatagggctatgattgtgtcactgcactccaacctgggtgacagagcgagaccctgtctccaaaaaaaaaaaaaaaaaagcatgtgataatagattgactatcttgaaaggaatgacagatttacaatgactaattatttttccttcaacttttattttaagttcccagatacatgtgcaggatgtacaggtttgttacataggtaaacgtgtgccatggtgtgcacagatcaacccatcacctaggtattacacctagcatcccttcgctattcttcctgatgctctcccttccctcacccactcccccaacaggccccggtgtgtgttgttcccgaccccgtgtccatgtgttctcatcattcagctcccacttacaagtgagaacatgtggtgtttggttttctgttcctgaattaataactactttttaagaataacaatgaaagataaaagattgtggtctacaaaaaaacaattgtcaacccagaatttcctacctagcaaaaatatctttcataaatgggggcaaatgaaagatgttttcatacaaacatagaatgtgggttttttttccctcttggacctttcctaaagtaaaatctcaggaatataacttaggcagatagaaagtgattccagatggaaactttgagatataagaacaaattaagagtattaaaatatgtgaggtaatggctgggcacggtggctcattcctgtaatctcagcactttgggaggccaaggcgggcagatcacgaggtccggagatcgagaccatcctggctaacacggtgaaaccctgtctctactaaaaatacaaaaaattagctgggtgtggtggcgggcgcctgtagtcccagctactcgggaggctgagacaggagaatggcatgaacctgggagtcggagcttgcagtgagccgagatggcaccactgcactccagcctgggcgacagagcaagactccgtctcaaaaaaaaaaaaaaaaaaaaaaagtgaggtaatataaaaaagcttcaactatgtaagaaaataataataccttatgggattaaaaatagaaaatactaaaatactctacaataatggcagagaagcagttgagtgagaaattcttgcatgtgtgccccaggaggcataaagaaggatgttcacagctgtggtatttgtaataacaaaagttgaaaataactaacgtccaccaataatagaatgaataagtatgtatagtgatgcaatgacatatttcacagcatgaattatagctacttgcagcaacctggttgaactccaggaaaataatattgagtttaaaaaagaaagtgataaaacaatacctcacattattaaaagttaaaaacatgcaaagtgaaacaatatatttatgcatataagcaatttggtgaaatgaaacagaaaaacaaaatataggataatggttacctttgctgaagaaagaatagatagtatttcagggtgaccaaaagggatttcagagacaacctttgtttattttcttaaactgggaggtgggtacatgggtgttaattatttgaggattctttgcatcttacatgtacttatatacatccatattctcttaatcaaattctatttaaactattttactcaataagcacctgggtgtcgtgggcactcagatgcagtttccactgtcctcagttaccagatgagatgtgttttggtttgaggctcatgaaaagatcatgtgagtacaagccacatcagtacatgcatgaaaagccactggcatagtttggcagggatggcggagggtaggggaatggcttggagtctcccctcagtttaaatactgttctggtatataactcttacaaaagtaagtgattggttcccattctgtagtggagctcaggtcaataaaatgaaagtgattctctggacaatcctaaaagccaagtttgtgagtgagctcagaacattcttggatcagaaatgagtacatgggaggccttgaaaacccctcatctatttcagggttgattttgccaacacctaggtgttctccagtcagggttctccagagtaacagaaccaataggatcaataagatatatttaggaattggcttgtgcaatcatgaaggctgagaagtctcaaaatctgccatccacaagcagaaaaaccaggaaggcccgtagtataattcaatccaagtctgagccaggggagccagcgtcttgagtcccagtctgcatccatcatcaggagaagaaggaagtcccaaatcaaacaagaagcagatttgccatcctctgcctctttgttctgtttaggttctcgactcacattggcaagaggtcttctttactcagtctaccaatttaaatgctaatctcttttggaaacactctcacagatacatccaataataatgttttactaccttctggatatcccttggatcagttaagtggacacataaaattaatcatcacactgactaagggtcaaactgccccagagaaactcgtacagtgattcacagtccagctgctaatctttcctgtacagtcccaccctcttgccatagcttttatgtcacatatctcccaggtattttattataatttatattaaatttttcaagaaaattaaacacataaaaatgaacatacagttgtcccattgtatcctcaggggattggttccaggacccccatggatgccaaaatccacagatgctcaagtaccagatataaaatggtgtggtatttgcatataacctgtaaaatccacctgtatactttaaaccatctctagattacttataatacctaatacaatgtaaatgctatgtaaatagttgttaaattatattttaagatctgtattattttttattgttgtattgttatttttaatttattttgaatatttttgagcagcgattggtcaaatctgcaggtgcagaacccatggatagagacaaccaactgcactaacacactaccgaccacgacacccagaatatccaataagaagtgggaatccaccccccacatacattttgtgactatcccccttcacaaacctttcgaaatcccctaattaatcaagctattctattccatttcttccttctttacccacgacctcttatagccttctataggtaccgagagattcattgatctatgtatatcatttctttagaattaaatttactttctctttggccaagcaatccccattagtattaggttaactgagggccttaagtcatttatcctaaatatttttagtccagaggatcatcatacacgtaagttctgtttttatttaattctgtaacggaacctacaaaccctttactatgtaactctaatagaaagattaatgtctagcatatcacacacatcagtaaatattacagaatcagtttccatttgcatctttttgccatataacatgtatttcctgtaaatggagtttacagatcgtttttaaaaagttccaggttccgtctggtttatgggcttagtcatagcctggccacaggaaccccatttccaaggacagaggtatcctgatatccttgtggagcatcacccacccgtctccctgggtgtgaaatgatggtggcctttaatcagtccaatcccaagcagctgtatcttaggaacatttagccctctatccacagcaccctagccatgagaaaataacaataaagaccacaatttaggtttgccatagtggtcccacaaaatcaccccttccctccaatacatgcgaccgtattggtgaaattaacacatttataaattctttctgggcgaggacacatgccctctaacaatgttgttgcccattaatttggtcacccagtccatttgggaattgcattattggctttccaggccacctgccagctgtggtcagtttatgggaagagaactcctttgcaattccaatttgggtaaacaaatcattttcgaagtggtagcaagccctaagaaagctatttccacttgactaagcacacacagtcgattttccaaggcctctgagtcttttgtcttttttgttttcacctttccattatttatagctcttccctttctttttcttattttattacattggtcaagaccaccagcgttatgttgaatcagagcaataaatgataacaggtacaactgtcttatctcaacttcaatggaaatattgctaaggttttaacactaagtaactttaaacatttaaaatattgatgaggttttagcattatgtaattaagtaaccttaatttagcattaaggttttacctgctacatatttatagcaataatagtatttattgagtactgactaaatgatagtattgtaagaattttatttgcattatccatttcttatgacacccattttccagatgatgaaactaaattacagagaggttagggaacttgcccgtggcatttacatctgttagagattcgattgcaggaatgcttacttcatagttcaagtgtttaattattttgcaatactgccagtaggttgatgccctcaagttagaagagttccttttacctctagttttcaaagcataagctgcactaaaagatgaacatatacatcagaagtgggtgttataccttatcaaatgctcttctacaagttttagatggttatatgatttttgtcatttattatgttaataaattgaattgtgttaatgtatagaattacattgaaaaattttctaacgttgaaccattcttgcattactaggagaaaccttacttatttattacgattttatccttttaatgtactgctggcttagataagaccttttgctttattaaatgcaagcagtctttgcttttccaggcaccacgataactgaaatttgtgcatattagaacaatgtcttcactttacacagttctaataagcacaagttacagttagatcactactatgcacaacataaactgcctgtagttgagacttttttccttcttttcctcatggtattttagtaaggggctaaccttaactaaattgccaaataataatttttgatttgaatttatcttgttggtattccactatagaccagagagtccttgtcttaaacacaatgtactcaatgattcaacagctgtgttgtttttaaagtttttttcatatcctaatatttcataattctctgtactttctgtctctgaaggaatttcttgccattttttggttggtttgggacctttccaggattatagaaagaatggatttcaaaaaccaagtttctgctttttctgttgcaagcaatgtccaggaagctaatgtttataatatttccctctcttgatcttttcattcctcaaacctgggttagatttgaggtcaggaccattgtcctattggggaaaaggctgtttctaagggtgtcacctctgctgccagcctcagggctttgcaaccaggtccacaggtgttcccacacccatgttacaagctgaaatgtgagtttgacaactttggttgctatgtctgtcatggtgagcacaaaatacatagtatttggtgagattacttggccaaatgaccaccaaatttcctgtacaccaaggaatacttctcctttcactttcttcattttgaacagctctggttccctagactcatccccactgatatttttgcttgtttttttaatatggcattggtagaatatctattttacatgagtgaatttctcggtaaaccaattcactcccttaaaaacaaaacatcttaattttgttaatgaaaatctttctcaaatgtgttttgtaaatttttctacctaaaaaggaaattatatcttgtgtaagagaataggatgtaacataatttgatattttattgataatgctaagtcattataatagatattagttaatgtcttgtgctgaaactcaagacatagagactctttccaagccccttaagttttagggttttgcccttctgcagatgaccccaggctgctgtgcctttctagtctgctgctatatagactttttttgcttttcttctgataaattaggctgttagaaaatatatagcagctttcctgcctctttatattaatatagtttactgcattttgtgtgttttgattggaacacaagaaaatgtgttaggattatgtgtaaactaagagcaaatagattgtgaaggaggacctattttttctcacccaaaacaagggaattatattagattttctctcagatctttttcctcacctctaaaatttcctcacctctaaaatgggaatgataataatatttaccacttcatacttgtgtcttgaaatatatatatatatttatgtatgtatgtgtatatatatatctgtatgtatgtgtgtgtatatatatgtgtgtatatatatgtgtgtatatatacacacatatatatacacatatatacacatatatatatacacacacatatacatatacacacacacacatacatacataggtttatatatatataggggtttttcttgtgtgtggtttttttttttttttttttttttttttgcttattttgtcacctaggctggggtacagtggtatggccttggcttactgcagcctcaatcttctgggctcaaggatcctcccatctcagcctccagggcagctgggaccacatgcacatgccaccacgcctggctaatttttgtatttttagtagagatggggtttcaccatgttggccaggctggtcttgaactcctggcctcaagtgatccacctgtctcagcctcccaaagtgctgggattacaggtgtgagccaccatgcctggcctgttttgaaatattaatagaagttagatggttcagcaagggtgaaataaaatcagtaattctctgggaggtaaaattgacagggcttggtgactgctgcacatggcagtgaagaagggagatttccaggccagtgcagggttttcaggtgggcttttgagtaaatggggagagaggactcccaggcactgtgtggattccctaaggtgatccacaggaaggaccaggcacacagtagggctctgcgttttctcagtcttctgccttcatttagattcccagcactcagagtcttttttgaagcaccccagatttaactggtggagatgtcagtgttatctcaaacccctccttccccagcatttcaactccagtctcctaggaaccaagaaaatgcagttgcctacaggtcccttggctatgtctcccagctcgcccagagctaacagcactatcttcttcactgggagagatgtcctaattcagacccgaaggctgcttcacattagcagatgctgactgcgggtgggcaagtgctcgaccctcaggccctgacactgctctaagtgggagacaggtccagctaggagagggaaactcagtcacagcgcaggagggacaggaggcttttagtaaaagtgccagtcaccaggggctgctgataccatcgcacaccaggtctggttacagcttcctgcctccctgcagaagctagcactggagttggagaaggggatgagggcagatccctgaatgagtgggaagggggtggctgggaggagagggaggcggagggagggagggaggagaagtgaaggggcagcatgattccagtgaaagctcttactctccagatgaaaagcattttgtagttttgccttaaatcattcccttaaccatagagttggagatcacttttttaagaaaaccggtagcacctgcaaaaaggagcgctatcttttttttttttttttgagatggagtctcgctcttgttgcccaggctggagtgcagtggcatgatctcggctcactgcaacctctgtctcccgggttcaagtaattctcctgcctcagcctcccgagtagctgggactacaggtgcgcaccaccatgcccagctaatttttgtatttttagtagagacggggtttcaccatgttggccaggatggtctcaatctcctgacctcgtgatctgcccgcctcggcctcccaaagtgctgggattacaggcacgagccaccgcacccagccaagagcactatcttttaagaacataaagttctgtgtttctcgtagggcagaagaccatgccaacttctgtggcacacagcccttcttatctgcaccagttgctgccacatggcttgcagttgcttctccttccttcaccagcaattggttactgacagcatgttgtagccaaaccctgagctccaggaactgcccctacgaggaatgaagcacccagcaggacagaggagcttctgaccttgcaaagccaatgtgaggttgctgccttgcgtttaaagctagcggtattcttccctgtgctcatctggccactctatttggttagtgttttgctaatgagttgagggcaaggagctgagccacacatggtccattatcactttcttgtgtggtcacagatagcatgccaaacctggtttcaaacccttctcctgttggttacaaagcagatgggccaagcaattctgactgcatcagtttaattccaatcattactatccaattaaagcaaaacgcttgttactggccatgatgtcacctttaccaaaagaggaggtcttttttttttttaatagagcattttctctaggcctggtgctaattaaatgctttgcgtgcatttctcactgatccttataataatccctccagataggtattgctttcacacctccattttacagataaggaaactgaggtctgaagagatgaagtcacagacgtaaggtaacaacctaacagagtacgcgtaagatgacctgtgctttcagacttgactcccaagcctcttgacgtaatttaaaggtgtcatctagttagtatctggtatctgccaccacccatggcagctcacaactgtcttttttcattctgtcaccttactgaagaggctccgctgtctattagtgctgggaacaaaaatgtgtaagaggaaggctctgcgctagagcactggaagctccggtaggaatgctgactgccaggaaggtggggctgagtggctccaaggagccttctagagagaaggcacagcgcagcgaaagtcatggatccagggatgggggattctatctggtggggtgtggggtaggctgactggagtcaaatcagggcgggccctccttcctgaaagttgagttttgactttcacaagagctcctgggttataggcagggaaatgactagatcacatcggtgttgaagaaatatgtttcactgtttacctcctcactacgtaggccctttcatttccagacatgtctgtgagaagtccttaactcctactgtaatctgtttccagaggatttttttttttcctccttggtcttttaagttggctgtttcctccaaggatagaaggaaatcccctggtagcttcaagacctgtgcaggggacgccttgcccaaggaacaagaacctggataaacattgggtcgaccatcgcctccaggtctgatgagcacagatgttttctgaagagttctggaggtaccttgtggcacctgaaccatgctctgttttccttgcaggaggcttttctttttcagtcaccgtttaaaacatgctttctacctgttcagaaaatctagttcaggtcgacgaagacctttgggatgaaatctcaatgcccagcctggagattgggccacatggtttctactagacacaccattataattatgcatcagaatcatttatacagccttgggaattttctccatatgtcccattaagtttgggagtcaccagggccctaatgacactgggaagttatgaaacatcatatggaatttttacagttattttattgtcctcttgctctcctcctcaatgcttgcagcctcagggactcagagtcagtctaacccagagtttctcaaccatgacactactgacacgtggagctggctgattctttgttgtgaggggttgtcctgcgtgttgtaggatgtttaatagcatcccttgtctctacttactcaatagtagtagcaccccagatatggcaatgaaaaatatatccaggcattgccaaagccacctgggggcgggggcgggtgtgtgaaattttccctttgagaaccactagtctcacctacattctaatcctagctgctgctttttttttttgttttgttttgagatggagtctcgctctgtcgcccaggctgcagtacagtggcacgatctaggctcactgcaagctccgcctcctgggttcatgccattctcctgcctcagcctcccgagtagctgggactacaggcgcccaccaccacgcctggctaatttttgtatttttagtagagatggggtttcaccgtgttagccaggatggtctcgatctcctgacctcgtgaaccgccctcctcggcctcccaaagtgctgggattacaggcgtgagccaccgcacctggccaatcctagcttctttacttccgagttgcatggcctttggtaagttgctgaaactccaagagtcttagtttactaattcgaaaaatgggcatccttgtatttacctttcaaggctgttgtcagatgctgactgcttcatttaatctgcagaaaacttgagtccaccttccctataccctgtccaatattccatggtgtgggaatcctttctacctcacgaatggatatagatttcatccgaggcctaaccaaaatgaaactgccaagctgagtgacatagagttgcaaagggatggattccctctttgactggcaaataatttgctgggagcatcagctttttgtgcttcagtaactgagcatcccatttgaggcctgcagctcccgagctgcccactggactcagtgatggagcgcttggatctggcttaagtgggtttgagtactccaagttgctggccattctcattctttcttgcctactttccatatactctgcactagaagtgtttgtctatttgtatttcccaaccttgctctctctgtccttgtttccctccctacctggctcacacagcgcacaaacagttaagggcacttagcttagctgcctccacatccctgtagactaccctggaaggattgaatgaaattgatagtactaacattacatcactcacatccccaaagcaagtgtagctgggcgggtagaaggaatgaccctggagaaaacagctgtcaagggcagctattggcttatctttcatggaaagagagacataatgaattctgaatgaagaggaaccagaggcagagcagtgtgtggtcctgcaaggccgccacacgcaagctggcacttgggaagtactgaggactgtctcatgtgtacggggtcctgggccagtccttctggcctggccatgtttgaggaagggtgtttttgtgctctggagatgaacactgcttagaggttgggagcctgctgtcaagggagtgctgacactctgccagttcggtctgtctgcagggtggtgggctgcacataggtgggggctgtgtgcaggcaggggccctgcctggggatcactttcacaggacctggccccagagaaccatgcaggcctcttctgcctccttttactttaatacccttgtttaccctctgctgtgtgtttttatttctccgagtacaggcatcagttggggctttcttagggaggcagtacattttcataggaagagattgaacttggggagaagctgacccacacttgaaacttgtcttatttacctttagaatatgttaccctcagcaagttactgtatttcttggagattcagtatttttaatctttaaaatgggggcaaaataacacttacctgttaagagtttttgtaagaattagatggaatgcacatggagagtctagcccagtaggtggcttgtattattacttattagtgacaactaaggctcaaagcattgaaagaacttttggatgtagtcactgagccaggaagtggtggagcaatgacaggatcccatgggagctgatgccagggactagctgtactccttccctcagatcgcagctgccaagccttaggacacaaaggcaccaagcaaattggaatagtgtgatgcgaataaggactcatgtcctagaatgaggctcctgcatcccccacccattacctgtatgtaccatcattgatagcttgctttttgcagatcataagcgcctggtaaggtagcaccttatatggcggctgctgagggctggagagttgaaagttatttcttccattgaactctaagaagcatactcaggttggggccgtgagtgaggggtaggagagccttagctctcctcatcaagcctatgtctagtgagagacacaagcatgaacaatgatggaagtatacatgtttggaagactgagcatagggcaccatgagaagatagaacaagggcctggtgtattcctgggcaccatggagagctgctctaaaaagtggctgatatccaagagatgaatgagaattgggacacaaaaaggaggaggaggattttaaggaaagaaaataggtggacatgaaaatccacgtgggctcaaggaaaaagagatggagaaagtaatttgtccaatgatgttggattcttttttttttttttttttgagacggagtctcgctctgtggccaggttggagtgcagtggtgcaatcttggctcactgcaacctctgcctccctggttcaagtgattttcctgcctcagcctcccaagtagctgggattacaggcatgcgccaccacgcccagctagtttttttttcttttttttttccctgagtttcgctcttgttgcccaggctggagtgcagtgatgtgatctcagctcagtgcaacctccacctcctgggttcaagcgattctcctgcctcagccttcctgagtagctgggattacaggcatgcaccatcacgcttggctaattttgtatttttagtagagacgggctttctccatatttataggctggtcttgaattccagaactcagatgatccgcctgcctcggcctcccaaagtgctgggattacaggtgtgagccactgcgcccggccaatctcggattcttaagaggtcacttatccttcctgggattgggtaccaatgtcccactgcatctttctagtgggttcctctttccattcatcataatcaaatgattcttgactaggaaagcaagtggttatgcaaaagggaaacttttttggttttgtttttaaactgtacagggttgaagcaaaaatccattcatgtccttgttaatgattgctcacattcttttggttgattcttaaagcatgtattttaataagggactggaaaccacaactgttaatcaatgttctcttggtttttacctctgagtcatggctttagatcagggagatagcatttcagatttgctactgggtgagaggttttgcatggcttatatgatattacctgatttttttacaaagtttagaggctacaaaactatccaggttttatgatctctactgaccttgtcagattgatgatgggatgggtgctgtgtttcccattttatggatattgagtgtgcaagagatgacagttatttcttttatcaacttccagaaagtgaactctggttgagacctgcaatggtgagagagataagatcactcatcaaggcaaattgattcgcagataaatgaggcattcagtaggtggtgaatgctaagaaagacctatgtcttctgaaaactgcatcgttaattgtattatgttattgatccatcttgggtaatgatagtgttagggaaagcgagttgcaaagttggttgagaaccattgctttgtctcttcaaggcacttacatctgaaaaggcatgggcaggagtgggggaaccctgtggttgccattctgttgccaaagggccaatgcagggaggtagcttgagagttaataatggagagtggttgcagtttccataggagagaagccaggagtccaggctcactgttcaggggtgtgtgtgtgctggatactaggacggtgaaaataactgagatggagttgggagagaagtgtatgtatttctcacgtgcctggatctgagaggctcaatatcttgctatacccatgagtgcaagtctgttctctgatttgaggaaagagatgggccaagggaagaatagacctgagggtcaaagtagggtgccttccctgagaagtggtgccagatatagcaaatgaaaatacagaacactcagttaaatttgagctttggataacaaataagtcacttattttttaagtataagtgcgtcccaaatattgcatgagacatacttacactaagggaaaaaaccccacaaccctaaagttgttcatatgaaatttgaatttgactgggcgtcctgtattttatctggcaaccctactgaggagactcagaatgctccagtggcttcttgctcaactgcacggacaggggctgctcctttgggccacttcaagcacattatttggcggtggccacagggcattctgttgggcatgcagctcctgagactgagcctgctaaagtgcctggctgcggggtggagtgcctgccaggagctgcgttcttccacagctttcttcctgggatcctgcagtcagggtgtcattccatccctccttccctctttccctgtagcatgtgaccatctcatccttgctgtttcttgctgtgttgcttctgtcccccaaccctgcccttgaagccttggttctcttgggagccaggtaaatactatgcctcagtctattcttctttccctgctcctcagacttgatgtcatggatttgactcaaggtttgtgtttcacatttacacttttcctaagcagagatgaggagcaccgccatggagtaagcaaaggaaccttgggcgagtagcaagcatgacatgagacctccccacagtccctggcgtggtggcctccatcctgacttcgagcctgaacttctgacatcctcatctgtttctactctccatccctgcacaccaacacacctctgcactcacagtttttcctgtggttggcactccggggctgtaagggccctacagagatagccaaacttgctaatatgctaactagagttagtctggccaaggagaacataacccctgtctgatcatggtgtgcttctttgcccgggtagaaacttctgcaggctccctgctagcagcagccagtgtcactctggaaggccagggcctgctaccttggcagatccagctaacaacagcagagggctcaggctcctggtggctggtccttctggctcaggaagtcactttccctcccagctttgggttcgtaggctctggacccagcctcgacatcctagccctgcagcctactaatgggggtgaaatcagcctccccacagtcaacaagacttacgtcacaaactctaaatgttaaaatctcatccagtggaaaatatccttaatattttatttctttgaacaattgccatgactaggactggttacataacatgtgggggccagtgcaaaatggaaatgcagggcctcattttaaaaaagtattcagagctggccgggcgtggtggctcacacctgtaatcccagcactttcggaggccgaggcgggcagatcacaaggtcaggagattgagaccatcctggctaacacagagaaaccccatctctactaaaactacaaaaaattagccgggcacggtggcaggcacctgtagtcccagctactcgggaggctgaggcaggagaatggtgtgaacctgggaggtggagcttgcagtgagctgagatcgcgccactgcactccaggctgggcaacagagcgagactcctctgtctcaaaaaaaaaaaaaaaaggattcagaacttcaagatggtgacggtggagcattaaaccaagcatggggccttccaagtgcagtgccctgtgtgactgaccttacacacctgtgaagctggccctggtcatgacctctttatcagttttcaaagtcatatgcctttctgtgttcctgaacaaatgctctggctgtattgtcaaatgtaatggcctctccaagtttgattacttgtaagtctcaggtctcttccttgtgaaccaaagcttggtcaatattcattcaaaaaatgaaattcatttcaaatggagacaggtatgatggatgtgttaagaacctagctgtgagagttgctagcttctctctgtccgtcagtccttcgcatttctttccatacgcagaccttttgcattaacaaggagagttatagttcagcacttcatgtccgtcttctttgttttcatagccctggctgttcaccttggttaagtgacacaattattcccttgtcattcttcttgcatgttaaatagggataactcaaaggattgtatcgctgataaaaagaaatagcccctgtaatgtttggatgctcaataattgttcacatgttcccttctgtcatctcatctggacctaggtctgtaattgcaatgcatcaggagattagattttttttttttttttttttttgagatggggtctttctctgttgcctaggctggagtgcggtggtgcgatcttgaacttggctcactgcaacctccgcctcctgggttcaagagattctcctgcctcagcctccagagtagctgggactacaagcgcccgccaccacacctggctaattttttgtagttttaatagagacggggtttcaccgtgttagccaggatggtctcaatctcctgaccttgtgatcgacccccctcggcctcccaaagtgccgggattacaggggtgagccaccgtgcctggctgacattagatcttataactcgccagtagctgggaatcagaacaatgttgagcaataaagcagttttgctcatacacacacaaactagtccataacactggtgtgttttcattcagactctctttaaggtgataccacacacttgcctaatcctgctgtgagaaagctgccttctccagaactggtgaagttcattctgatatgagaaccccaggactaaccttggacggagtgaagtgaggcttatgtaaaaggagatttattgtaagaaattggctcatgtaattacggaggctgagaagtcccattatctgccatctgcaagcaagctggagacccagacaagctggtggtataattaagtctcagtctgaaggccagagatgagatgagatgtcccaggtcaagaagtgaggcaagaaaaaagggacaaattcctccttcctccaccttttgttctattcatgccctcagcggattgcatggtgcctgcccacattgggtgagggtggatctttctcactcagtccactgattcaaatgctaatgtcttccagaaacacccatgcagacacacccagaaacaatgtttaatctgggcaccctgtgcccagtcaaattgacacacaaaattaatcatcctaacatcccagagctcatcctgccattggttcaaatgtgtatctgaatcacctagaaatggttttcacggggcaagtgccaagaccccagtcccagaagtgctggatcatagtgtccaaaataaagtctggcttgagaattcgacaatattttcaggagattctgattcatatttttaattaagtaccattggattaattcaccctttttcttctacacagaagggaattaagaactggagtcacacccttctaagttcagaaaacagttttagttggaaaaaaaaatcaatcttcaaaatgtgaagattaaaaaaaaaatcccatcaaggcacatggaaatggtcacaagctttgggcccatttaaccattttccagcaaagttgatagcagaattaattaaggtcacacagctagtaagtgacagaaacgggactagaatctgcgttactgggctcctaaagcaatttttctctcctgtatattccctttcttgtctgctgttttgcttagaactaagtctagtcaatgagttgaactgattaattccagtgatatcaatactgtcttagtgaggagctcatgtgcttatacttcgaaaataaatgtttggaagtttaaatttattttcatttttccttattggggatggtcaaaactcaacacccaatgggctcaggtcaccagctgtctgggggtggaagacagagccctccaacgcagctggtgagcttccatcactcctctgtgtgttggatgtctttctcagttatgccctagtggaaactgcagtccagcctcctggtaatgccatcacgattatggttgatccgctctgtgtagccgaaataggtgtgatttcctgagtaagaggagcattagctgatttcttgaaaatacatgctccctgatttagccaggttcatgtgctttcacctttttatgtgtttaattaaaaactgaaaatgtcctctgccctgaaagatgaatgaggagaaatgccctattattaggacacaccacctttggagtgaaatgattcactctgtgattaaatgcaaattgcttcttaagaataattagcccaggtggcctgtaagcccagggagctcacggttcatcaggagcagtattcatccaattacttctttactgaagattgggtgcccgatcgatcatacttcttggctttggaagggctggaggcacaccctcctaagttcgaagatccattttaaatagaaacaaaataaacattcataatttaaggactaaaaaaatttaaatcctatcaaggcaaatggaaatgagcacaagcctcagatccctgcaacaactttccagcagtgacaaattcattctacaaacaagtcggtagaatcatttttcctgaaaaaggaacctagataagggatctggtatttgcaaactcagttaatgtggcttggttgggcctgttgttacctgctctgattccttagcccatagcttacccattaaactaactgctcagatgcacctattgtttaagtttctctttaaatgcacaatgataatagctaattctgcaaagcccttgtatgtcagatcctacatgagatgctttgcatattttatttctcaccaacactgtaagggaaaggtaagattagcaccattttacacatgaggaaactgagatagagagactttaagtagccaagattacaaagccaatacatggccttcttacaaatgcgtagcatttgtgaaaaaactgctgagtaacagaatgtggatgcatcaggataaaatctaaaatgaccgggaaaacagttcaatgattgccttgctgttgctgagtcagtagcatctttaaaaagaaacagtatataaaggcacatgcattggtgcctgtgttttgagcaaccatgtcttaacaggacagccattcccctcctctacttcatttgtatctctgaacaagaacaaagttcacatccttcagatacataggggttgagaaagagttaagttaccgtttgggtaataaaggaattaaaatctctttcaagcaggtcataattaattcttttaattatagattacttgaaaagggagacaaaaggaaggaaaagcttttatcatctgattaataaacctctgttagcattttcatatgccctcatgtaatttttttctctgctacctgcttcagttactattgcagtgtaagagatttttttcaaatttactggtttaaaacaacaaacatgatttcaccgtttctctggactgagagccctggagccgtttagtggggtagttctgactcaggctctctcatgatgctgcaatcaagctgtttgccagggctacagtcatctccaggcatgactgcagaaggagccactccaagatggtcacatggctgctggcagaccccagaagacctgcttccaggcttactcacatggctggtggcaggtgtcagtttctcaccacgtgggcctctccatatggtgcctgagtgtcctcacaacatggcaggtggcttccatctttggcagctggtttcctccagagtgagtgatgagagggagaaaaagagaaagagaggaaggggggtgaggagagagagagagagagagagagagagagagagagagagagagagagagactgaacctacacatggaaattccagtcaatcttagaattgacattccatcacttctcaattcaattcactagaagcaagtcactaagtcactaagaaattaagttacatttcttaaaaaaagctatcaaagagtttgtgggctgtctcatgcgtccgtgtgaagagaccaccaaacaggctttgtatgagcaacaaggctgtttatttcacctgggtgcaggcgggctgagtccgaaaaaggagtcagcaaagggtgatgggattattattagttcttacaggttttgggatagacggtggagttgggagcaatgttttgggggcaggggatggatctcacaaagtacattctcaagggtggggagaattacaaagaaccttctcaagggtgggggagatcacaaagtacattgatcagttagggtggggcagaaacaaatcacaatggtggaatgtcagcagttgaggctattttcgtttcttttgtgaatcttcagttgcttcaggccatctggatgtatacgtgcaggtcacaggggatatgatggcttagcttgggctcagaggcctgatattcctgtcttcttatattaataagaaaagcaaaacaaaataatgaagtgttggagcggtgataaattttgggggtgatatggagagataatgggtgatgtttctcagggctgctttgagcgggattaggggcagcgtgggaacctagagtgggagagattaaactgaagaaagattttggggtaaggggtgatactgtggggttgttagaaggagcatttgttgtatagaatgattgatgatggcctggatgcagttttgtgtgaattgagaaacgaaacggaagacacaaggtctgaataaaagaaggagaaaaatagatattaaaggactaagaattgggagtacccaggacatccaattagagagtgtccaggggggttcagcgtaattatttgcttggttggcaagtttttaggctctatctttcagtttttttaaaaaaatgttgtcatataccaggccagattgatttagggaaaaacagcactcttcatttaaaaatatacagagtcctcagagggctgtttctgggactgcccagcactgcttgatctggaagtaggtattctccccaattttgtggagacatatgtattccttttccgtttccctttgctcacctttagcatttgctaagttaaacattgtactcttttactacattgattattaaacttttcttaaaagttttcttaaaagaaaagtttaaaatcaatgtagtaaaagtacaatgtttaacttagcaaatatatatatatttgctatataaatatatatatatttgatatatatatatatacacacacacacacacagagtccccccactttttttttagcagtgagtaagtcgaggcctcagcgattttggaggaaagtaaagtgcgtgggcgtgtctttaaaaccatcacatagtatctttaaaagggttgggattataggatatatttggttatttaaaagtctttttgcttttgacataatggaaaaaattagtagctgcataatataccataaagtggatttttcataattttcatacctacatacctacctaggttgttttctaatgtctgttagcacaagtgatgctgtatagatgtttttgctgtagttctttatatttcattgggatacatttctacaagtgtgaaaacagagtcaagtatatggatatcttctaaaacttttttatacctatggctatattccttttttaaaggggtgggccagtttactgtcatacctatcagataacagattcactgaagtagctaaaaatcatgtttcaagtctcaatgatggtgcagcagtgatataaacagtatgcgatgactgctttccaccaaaacggtgccagctgcttcttcaatgtcccaggtatcatgggacctggttgacacagagccctttctccataggcttggctaaagaaaatcacaacaatagtataaataatattgtgttacatagcatgtatagattgaaaatttattctgtatttcagtggaacatttttagaacactattgctgaggtagtcaaactgttctaggagttattaagaaattattttaggcaggtagagaggaaaagggatcctcggaaagttttcctctgttttaaagcagctccagaaacgtttcttgtctagtgggaaaacctagctcttagaactgggcaggcaacctttgatatgcaaacgcaagccattagaaactgcgtccacccaaacatgacgattcctaccgttgtcttcttgcccttgccccaatatgtgcctggccacatggccgcctccacatatccccacgtgtgtagaatattatggagccctgcatttgcatattaaaagactggggtgggagggccagtttttttttcacgggctacgcgaatgacctgcctggtcaaaccaatccggtgagccctatgcaaatcaggcaccacctcctccagcctcctcataaaattggctggtatccacggcacatgggatctactctttcggttttggaccccccctccctctgcctctgtacaggggagcttctttctttcttctcccttctttcttgcctgttaaactctccgctccttaaattcacttcacgtgtgtgtcatcctatctaatttggcatgagacaagagccctggtgctcctccactcataggggccgtatcaaaactacaactattatcttttcaaatatttccttcccaaacaagtaccatatgtttaatgtgtgatattattatggtagtaatattatgaaagtgatttgtagtattgcttagttcttaaaaataattgtattataattaaactatcattacggcttaatttctcttcgttaatgtaacaattttattaaaatgtaattcacatactatacaattcatcaaagtgtacaattccatagttttaatatattcatagaattgtgagcacacattttagagcattttcagcaccctaaaaagaagccctgtacccatttgcaatgtgacttcatttattctaaaaagaaataatcacaaacacctccttttcatggatgcctaggactttttctatctatctatatctatatctatatctatatctatatctatatctattttttgagacagaatcttgctcttgtcgcccaggctggagtgcaatagcgcgatctcggctcactgcaacccctgcctcccgggttcaggcgatgctcctgcctcagccttttgagtagctgggattacaggcatgtgccaccatgcctggctaattttttttttttttttgtatttttagtagagacgggtttcaccatgttggccaggctgatgtcgaactcctgatctcaggtgatcctcccgccgaggcctcccaaagtgctgggattacaggcgtgagccaccgcgcctggccctatatctttttttgtgatctgatttcagatgtggagaaagagagtgctttgcccaatactctcaaaaattcgtcattggacacaggaatgaaagccagccctctgtggccttaaacagagctatggaatattagacctcatttagaggacagtttatttccctcagactggggagctgagagattttttaaaaagctctgtaaaggtaaatatttcaaatatacggagcatattctgatgctcttgatcagaagcatcttgatgaaatctttataggaggttaggctgaaaaaaagagctgtgagtaatcagcaatgtgccaggcatctctttactgaccataagttcaacatatttttcatattgtcttccttttaaaaagacaattctggtgacttcgcttttttgtttttttttttttttttttgacacggagtctctctctgtcgcccgactggagtgcagtggcctgatctcggctcactggaagctccgcctccgggttcacgccattctcctgcctcagcctcccgagtagctgggactacaggcacccaccaccacgcccggctaatttttttggatttttagtagagacagggtttcaccgtgttagccaggatggtctcgatctcctgacctcgtgatctgcccgcctcggcctcccagagtgctgggattccaggcgtgagccactgcgcccggccgacttcacttttaggtcaatgaaatcactgtctactggtgtcaataacaaaatgataaaaaaaaaaaaaaaagaaaaaaaagggaagcgttttgcacacaaacagaatagaatttcagcttgtgatgcagggcctctgtgaattaattcacttcctctagaagcagaggacaccaatttcctcccccggaggtcagaagcggaaggggtagggttaccatggagtctagattctaagagacttttgaaatgcaattgccctgccggttttgtttagctacaaggttactctcagacataggcaataatgagaaagtaatagctgggatggtcttgggttgacccacgcagataaggatcaacttttttttctttaatagggggccatgtgaccgtgatgactgctgtttctttcagatacttttggtgttgactggtcacccgaatgagacaaggattcttaggtcaatccattttcctgcatcaggagacacacgtcaaaacttagcatcaaaattgcacccctttccatgactctgtccctctgtaaatggggaagagagcttcccttttggcccttgggcagaaggctgcttatttgtattcagtgattgtgttagcggaaaggggtccccatagagactcccaagagagggttcttggatctcaccaagaaggaatttgaggcaaatccataaagtgaaagcaagtttattaagaaagtaaaggaacaggccgggcacggtgactcacgcctgtaatcccagcactttggaaggccgaggtgggcagaccacaaggtcaggagatcgagaccatcctggctaacacggtgaaaccccgtctctactaaaaatacaaaacaaaaaattagccgggcgtggtggtgggcgcctgtagtcccagctactcgggaggctgaggcaggagaatggcgttaacccgggaggtggagcttccagtgagccgagatcgtgccactgcactccagcctggacgacagagcgagactccctgtcaaaaaaaaaaaaaaaaaaaaaaaagtaaaggaatatgggatggccacttcataggcagagcagccccaagggctgctggactaagaatacttctcgtaatttcttgattatatgctaaacaagggttggattattcatgagttttctgggaaaggggtgggcaagtcctggaactgagggttctccccccttttagaccctatagggtgacttcctgaggttgtcttggcatttgtaaagtatggtggcactggtgggaatgtcttaacatgctaatgcattataattattgtataatgagcagtgaggatgaccagaggtcacttttgttgccatctttgttttgatgggttttggctggcttctttactgcaacctgtgttttcagcaaggtctttgtgacctgtatcttgtgctgacctcctatcctatcctgtgacttagaatgcctaacctcctgggaatgcagcccagcaggtctcagcctcattgtacccagcacctgttcaagatggagtcgctctggtttgaacacctctgacaatcaaattgtctgctggtgatataagacttcctgattttgcagcagtaaataattctaataaaaggactccagtagagcctgaagctatagatatttccataaggcaagccaacctggagagtccctttgaggtgaattctggatccccacacacatcttgtagaagactcagatatcacctgcctataattctttgttcagtaggttgtatgaactggtacagataaaatgaaaacctagctccctcaaactggttcttcacctgaacctgaacccacactgaaacacttgaaagttctggtaaaggcacctttttcagtcttaaaacagaaaggcagatttttgaaagccaggcagttttaaaataaattctcctggagaaacagctgttatcaaagtaaattgtctctgttcaacgcatttactggtttatatggcaatccagaagtttaccacctctctaaaaggtcaggtctctttttctttttaaaattagacttgtgttcatggttattggtcaaacatatggtaaatacctgaatctctgcaaagagatgttcaaatttcaaagtgtttttacgatggtcatgtgcaagaacaccctgcatttagttgcacgcttatattcctttgttcaagctctcatttcagttttaaaaataaatgaaacaaatacattagcatttaacattttcttaataattgacatttttcaattttatgaagtttgtaccttctattttcagatttgttttgatcaggagaaagcccttttatcaaaagaaggcatcttgataataataccaactctgctcaattcaaaatgccattttgaagagtaaaggacagcgtatgtgaaaagtgctaggccacagtcaatgttttcttctgttactgctctttatattgttaaagaattcactgttaaatgtgttctcctgctgccatgcctttcaggaaacctgaatattttggaagaatagccatttttgatgtcctatgaatggtctttgaaggttcagcaaggatatttgactagtgggtttggtcttactttttatctcttacttgatattgtaatagatatgaaaggcacacgttctccagtgtgtgctgatgttggttgtgggagagatttgagagcactgtaatttccttggcatttcccccatgaagctctgatagtcccaaaacctgcgctcgtggccgcctgctgaacggctgataactgatgaagtagacctgagaaatatttggctctgcaggacttctgcaagagaaggtatccaaaggcactagtattagtgtgcagcacccatttgacctcgggtcagccctcctggtccttagtcccatgagccaggccccacatgctggccggctggcaaagtccggctttgcatccagttattgtttgctcagctcgtacttcctgttaacacattcagttatgttcctccatccaaccttctagaggagggaatagcatgttggtcagaaagtagattagaaaatgcctacatgtagagttgcttgatgcattgcaagcttctccgtccccttgggtggacccctagtgtgcccactgggatgctgagggcaacttgcatccagctttattcctcaaactgggactttcagatcctactgatgggagtataagcgtgtactgcagctttgtaaaactgcttggtgctacctattcaaactacatacatgcctacctttaacagggtaattctacttctaccatttgctggtgtccttctctgaccactgagcttgtcctttgtcacacagcctggatgtgatatgccggccattctccagtcttcgtgtgaaccgctgggagcaggtctgcttgctcgctggcttcatcggctgcatggtgcaatttgtgcctgatttactgaccctccattaggaaagcactcctctttggttcagtttacctaatgataatcaaaccctatggtttattttatgttcacagccctgaatttgggtctgatatttattcttaatattatttaatatttaatatatgataattaatatttctgatatttatcaaaaattgggtctgataaagtaggaggaacaaatgtcattgagccatcagatatgaaaaagtgcagcagacaggattgggctccttcaattaggcatttggggatatggttatttatgtatgtatatatttatttatttatagtttgagggttggagctgaaggagttgttgatctctacaatgagctaatttttagcattacaaggagttttctttttcaacagtgtctttatgtgatctctctaagtcttagtatgtgtgcttcaaattatacagaaagattgtgataagctgaattgcatccctccttccccaaatatgttggcattccaatctccagtacgtcagaatgaaaccttctttggagataggtgctttacagaggtaatcaagttaagatgagggcatttgggtgggccctaatccagtatgactggtgtccttataaaaaggggaaatttggactcacagacagacacacacagaggaagacggtgtgaagagacacagggaaaaggtggccatctacaagccaaggagagaagtctgcaatagacccgtcactgatagccctcagaaggaaccaaccctgctggcaccttgattttggattctagcctctggaactgtgagagaatacgtttttgttgtttaagtcacccattttgtgatactttgttacagcagccctaggcaactgatgcggacttgtgaaggattttcgattacaggacctaagagaaggtttatgagtattggaaattgtgatataaattaaggtctttagaaagaaagaggtgaataggtagaaaaggtttgaaaacactgactgttttttaagtaagagatatgatcttggctgggtgtggtggttcatgcctgtaatctcagcactttgggaggccaagggaggcggatctcttgagatcaggagttcaagaccagcctggccaacatggtgaaactccgtctctttggttcaatttacctaatgataatcaaaccctatggtttgaaaatataaaaagttagccaggtgtggaggcgcacacctgtaaccccagctactggggaggctggggcaggagaatcacttgaacctgggaggcagaggttgcagtgagccggaggtggcagtgagccaaggtggttctactgcactccagcatgggtgacagagcaagacgccatctcaaaaaaaaaaaaaaaaaaaaaaaaaaaggaaagagatatggtgtctaaggaagatcagtgagtggaaaccagccccaggaaagctactctcttgaataaagaaaatgactaaggtaatagtaatcttttttccacctggttgcctgggctgggcattttgtcaattgctccatcactaccagtgggtttgctgggcgtggggccatggaagcaagttttttctttctttcctactggtcatgggagtttagtcattttcacagtcaattggaaaataacagttgtaaaggcattttgaagaacacacgctggggcgttgggccaccttttcttggcttgaaattgaggcagaggggtcagaattaacaaagaaaatcatgcagcctggcttttattcttcagcaaacatttcctgagtgcctgctctgttccaggtgctggctgggtactggagccaatgcatggttgactaaagagcatacagtccctgcccacatggtacttagatccattgtttaagaagcaagcttagacctgagccgtgtaggagaatagctcacattcacagaggtgggaaaggacaatgttttagtaatttgaatggcattaggctgaggaacagacagcaaaagcaaggcacaggggcgtgttggggggaatggggagacaaaggccccatcccaagtctttgaatgctcttctgaatccacacactgccactgttagcccccctgcagttaggaacttgccggatctcccatcaaaggtgaattccgcaggaaagagatgggctttgaataataatgcctgtgttacttttgttaattcttccctgagcgtaagtcccaaaggctggagaaaaagcaaatcttttttcagtgcatttcatttgaaaagtaaatttcatccatttgtttctagatagctcttgcctccggccttgaacaaaattaattttggaaaatgaattccacttggcaactatatatcttgaaacaagggccagcctttaaaaatgtgttgcaatgtgtacacttggaggcatgagaagtagatacttgtaagatccgtgcaatcctggttcagtattagctccttctctaagggcacccatagggcccggttctcggtgaggggcctccctctgcaggtggagtataagcatgcaattcctgctcccaaggagggggcttctgccatcttgggagctgttgggggaaactttggagaccaccaggaacccctaaagcccttgagaactttaagaagacatgatgctggggtggagggttgtgggggtgaatgggatccaccctcctctacaggtccttgattttccttgggctgctgtactaagggtctactttcttctctctttcaccacaccctacccccttccccccatacattaatgctttccagtgacatgctatggcaaacctaaagacctgcttgatttagtcctttaagctaaagaaattcagccttcctaaccataactttctgtttgggagttagagaatcacagaatatcacattgcatggagcctcagactgatggagaactatttttcagtattagagcagcttttcattacccattctatatattagaatgatgcgggaaggtgaagaaaatcagggaactagtaaaactgagaaaggaaaacaagttgatttttcattaattcgacagttgcggagactctatatgtaggtctggccctggactaagcacaggcgtaaataagactattcctgtcctcaagaccctacccatttaccaggggagagaaacatctaagcaattataatacagtgccgcccagtattgtcatgtttgcccaagatgcaggggaacgtccgggggaagggcaacaataaacagggaagaatttggaaaggagttggtggtggagctcagtggtataaaccagtaggtgttggaagctgagagaggagttttaggcagggcagagcagagacaatgtttgaagacagggagagcacaatacgtccggcaaagtgcaataggaagagagtatgtctggcgtggagggtgttacggaggtagggcaggagcaagacaaaaatgtgggtagagacagaccaggataagtcttctgggagcctggagttctctttcaagggatgagcagcagtcggggacccatggattcaggttggtattttagaaagagcctgctggtaccagggtggaggtggattggagggtagtgagcctggaggcgggaataaagtggaaaagtccagtctggtcccagcatcccaggtgtgagccacgtggccttcggtaggtctgttgctatgacgtcaggggcatgctgtaatctgagagcacttgatggaatgcattctcttacttaaagactggctggaccaattatttattaaccatacaggtggcttttctgtataccttgactctgacactcactcttcccagctctcaagtccagagaaaacaaactagttattgagactgttcctggcactagtgatatagttgtgaatgaaatggacaaaagtcccttcccttgaggagcttccattctaccggcgagacagaacataaacaatcgtacacattaaatgacattaaatgataggcagcaatgaaggctctggtgaaaaataaacatcgggaaaggggcttgcaatttacaatagggagccagtaaagccgcaatgaggtgctattttaacaaatttgaccccggagggaccttcacttcaagggctaagttgtttaaagggagggcaagtgtggtccaattgtgcttgcagaggatctctggaccttaatggggccacgagctatgcttgctgtccctggagggggcagccaggctgaccacagaaaatctgtgatggaaggagggtctaataaacactctctgtttctcagcttggagctgatcttaaatattcaaagcaactcaccactcccttctcctgttggcccccagtttatttgctgaaaagaaaaaaaagttcagctcagctgtagcatctgttttctagtgaagtccttgcttcttactcaattttccagctggtttgacttatcagtacacaagcaggtcacctgactggctcagggccacacagtgagcaaaagattccaccaaaacaggaacccaaccttatttttattattatttttttatattgcacagtttctgggagttccacagttgtggcagatgggatgctaatcacattcacggaaaatgtatgcaaggaacttcagtgcagaactctgcatctggctcgaggactctgtatgactcgacttccctagtggaagggggaaagcagagaaacaccctcctccatccattaaaaggccattttgcacatgacttgaagactccccagttggaggccctcgttccagtgcagctgcattttgggttgcatcctcttcaaagcccacaccccaaggtgtggccttgcccagttaatttattttttctttccccacttcccttcttctcatccctgttcctcctgccgccgggcaatttcaagttcataagcaagctgctacagtgttagggactttctgggtagaaatggcatgcggttgctggtgaaatcttaccagtatttgcggtgaggttgagattgacacaggtttagaaaatataaaaatcacctatgggccctctcatttgtgattctcctttttgtttgcagtaacctttgggttaagtctttcaagctaatccattcagcttcagtcctttaaccctttgatgtttgttatctatttaagctacaagaaccttatcttcaaatgaagattaatgtgaaaacaaactggttgtggctttcacagaagttccattggatccaaagcccctgcccaacaggcttctcctgtcccctctccacacatcccctttgtgactcagggcctgtggaaccttaggcaaaggtctttaactctctgagcctcagtgttctcatctgtcatttgggcacaattatatgcacctcttggggtgttggtggggatgaatgaaatggtacatacccagtgacttgcacactgaatggtcaattagtcttttcttcttgactcattctgaggtgggttctaagtggccatcttgattttttgtcaatactactgcttaagtgaatccctggagtcatagtctgaaaccctaagtatacccttcccaattccctactttaccagactaagcccttcactcaggtagttcatttcttatttttattattttccctgtctttctaggtacccccagggtttccttcctggctcccttctctaacctcattcagtcaccaatgtaaagttttcctttttattttgagaatgtcaaacatgtaaaggtagaatagtccagagtgaatattacagtggacactatatatccatcaactggaattaacaactattgacagtattaacattcattatcgtatattcttcatctttttttgctaaaatattttagagcaaatctaaacaattatgaatttcattgatagtttttcatgtacatatatatcactaaaaaataagaacatcttaaatattcacagtaacttaatcatactgtacaaaataaaaacccaagaatttattaatgtcatctaccacccagtccatattcaatgtcttttcatacatggtttgttagaatcagaatccgaataaagcccatacgttagctttggttctttcaatcgccaattccgcccttccccagtttattctgccatgacaagtcgtgatcactgggtttatactctcctctttttttttttttttaattttactttaagttttagggtacatgtgcacaacgtgcaggttagttacatatgtatacatgcgccatgttggtgtgctgcacccattgactcgtcatttaacattaggtattgggaggagtcaaaaggcaaggtcaaaggttaaagatcgtctctgtcttgacaggtattttgatggc

SEQ ID NO: 69 - DNA, 4118 bp, Homo sapiens
gcatattctgatgctcttgatcagaagcatcttgatgaaatctttataggaggttaggctgaaaaaaagagctgtgagtaatcagcaatgtgccaggcatctctttactgaccataagttcaacatatttttcatattgtcttccttttaaaaagacaattctggtgacttcgcttttttgtttttttttttttttttttgacacggagtctctctctgtcgcccgactggagtgcagtggcctgatctcggctcactggaagctccgcctccgggttcacgccattctcctgcctcagcctcccgagtagctgggactacaggcacccaccaccacgcccggctaatttttttggatttttagtagagacagggtttcaccgtgttagccaggatggtctcgatctcctgacctcgtgatctgcccgcctcggcctcccagagtgctgggattccaggcgtgagccactgcgcccggccgacttcacttttaggtcaatgaaatcactgtctactggtgtcaataacaaaatgataaaaaaaaaaaaaaaagaaaaaaaagggaagcgttttgcacacaaacagaatagaatttcagcttgtgatgcagggcctctgtgaattaattcacttcctctagaagcagaggacaccaatttcctcccccggaggtcagaagcggaaggggtagggttaccatggagtctagattctaagagacttttgaaatgcaattgccctgccggttttgtttagctacaaggttactctcagacataggcaataatgagaaagtaatagctgggatggtcttgggttgacccacgcagataaggatcaacttttttttctttaatagggggccatgtgaccgtgatgactgctgtttctttcagatacttttggtgttgactggtcacccgaatgagacaaggattcttaggtcaatccattttcctgcatcaggagacacacgtcaaaacttagcatcaaaattgcacccctttccatgactctgtccctctgtaaatggggaagagagcttcccttttggcccttgggcagaaggctgcttatttgtattcagtgattgtgttagcggaaaggggtccccatagagactcccaagagagggttcttggatctcaccaagaaggaatttgaggcaaatccataaagtgaaagcaagtttattaagaaagtaaaggaacaggccgggcacggtgactcacgcctgtaatcccagcactttggaaggccgaggtgggcagaccacaaggtcaggagatcgagaccatcctggctaacacggtgaaaccccgtctctactaaaaatacaaaacaaaaaattagccgggcgtggtggtgggcgcctgtagtcccagctactcgggaggctgaggcaggagaatggcgttaacccgggaggtggagcttccagtgagccgagatcgtgccactgcactccagcctggacgacagagcgagactccctgtcaaaaaaaaaaaaaaaaaaaaaaaagtaaaggaatatgggatggccacttcataggcagagcagccccaagggctgctggactaagaatacttctcgtaatttcttgattatatgctaaacaagggttggattattcatgagttttctgggaaaggggtgggcaagtcctggaactgagggttctccccccttttagaccctatagggtgacttcctgaggttgtcttggcatttgtaaagtatggtggcactggtgggaatgtcttaacatgctaatgcattataattattgtataatgagcagtgaggatgaccagaggtcacttttgttgccatctttgttttgatgggttttggctggcttctttactgcaacctgtgttttcagcaaggtctttgtgacctgtatcttgtgctgacctcctatcctatcctgtgacttagaatgcctaacctcctgggaatgcagcccagcaggtctcagcctcattgtacccagcacctgttcaagatggagtcgctctggtttgaacacctctgacaatcaaattgtctgctggtgatataagacttcctgattttgcagcagtaaataattctaataaaaggactccagtagagcctgaagctatagatatttccataaggcaagccaacctggagagtccctttgaggtgaattctggatccccacacacatcttgtagaagactcagatatcacctgcctataattctttgttcagtaggttgtatgaactggtacagataaaatgaaaacctagctccctcaaactggttcttcacctgaacctgaacccacactgaaacacttgaaagttctggtaaaggcacctttttcagtcttaaaacagaaaggcagatttttgaaagccaggcagttttaaaataaattctcctggagaaacagctgttatcaaagtaaattgtctctgttcaacgcatttactggtttatatggcaatccagaagtttaccacctctctaaaaggtcaggtctctttttctttttaaaattagacttgtgttcatggttattggtcaaacatatggtaaatacctgaatctctgcaaagagatgttcaaatttcaaagtgtttttacgatggtcatgtgcaagaacaccctgcatttagttgcacgcttatattcctttgttcaagctctcatttcagttttaaaaataaatgaaacaaatacattagcatttaacattttcttaataattgacatttttcaattttatgaagtttgtaccttctattttcagatttgttttgatcaggagaaagcccttttatcaaaagaaggcatcttgataataataccaactctgctcaattcaaaatgccattttgaagagtaaaggacagcgtatgtgaaaagtgctaggccacagtcaatgttttcttctgttactgctctttatattgttaaagaattcactgttaaatgtgttctcctgctgccatgcctttcaggaaacctgaatattttggaagaatagccatttttgatgtcctatgaatggtctttgaaggttcagcaaggatatttgactagtgggtttggtcttactttttatctcttacttgatattgtaatagatatgaaaggcacacgttctccagtgtgtgctgatgttggttgtgggagagatttgagagcactgtaatttccttggcatttcccccatgaagctctgatagtcccaaaacctgcgctcgtggccgcctgctgaacggctgataactgatgaagtagacctgagaaatatttggctctgcaggacttctgcaagagaaggtatccaaaggcactagtattagtgtgcagcacccatttgacctcgggtcagccctcctggtccttagtcccatgagccaggccccacatgctggccggctggcaaagtccggctttgcatccagttattgtttgctcagctcgtacttcctgttaacacattcagttatgttcctccatccaaccttctagaggagggaatagcatgttggtcagaaagtagattagaaaatgcctacatgtagagttgcttgatgcattgcaagcttctccgtccccttgggtggacccctagtgtgcccactgggatgctgagggcaacttgcatccagctttattcctcaaactgggactttcagatcctactgatgggagtataagcgtgtactgcagctttgtaaaactgcttggtgctacctattcaaactacatacatgcctacctttaacagggtaattctacttctaccatttgctggtgtccttctctgaccactgagcttgtcctttgtcacacagcctggatgtgatatgccggccattctccagtcttcgtgtgaaccgctgggagcaggtctgcttgctcgctggcttcatcggctgcatggtgcaatttgtgcctgatttactgaccctccattaggaaagcactcctctttggttcagtttacctaatgataatcaaaccctatggtttattttatgttcacagccctgaatttgggtctgatatttattcttaatattatttaatatttaatatatgataattaatatttctgatatttatcaaaa

SEQ ID NO: 70 - DNA, 383545 bp, Homo sapiens
tgtgtgaattacaggtcaagattctttttttctcatgcaaataaccaatgactctttttctcaatgtacttcagtaatatctttctcataatttaaataatgtatatttgtgtacatctttctcataattcacataatgtactgtttctggattctattttattttaatgtttgttgttgttgttgttgttgttttgttttgtttttgagacaggttctcaccctgtctctcagtctaaagtacagcggcacaatttcggctcactgaagccttgacctcctgggctcatgcaacgctcccacctctgcctcccaagtagctggggctacaggtgtatgtcaccacacccagctaatttttaaaattttttttgtagagatgagttctcaccatgttgcccaggctggtcttgaactcctgtactcaatcaatcctcctgccttggcctcccaaattgctgtgattatagacaggagtcgtcacacctggcctacattaatgattaatttttaaaatctttttgcaaatacaaagctaccttaattaatgtagatataataagtctttatttttggaagtgttagtttctgtttcctttttatcttcaagattatcctggcttttttggctttttcagttctcaaaagtattttatatatacacacacacaccctcatggggttttgtttgacatttctgtaaatatttcatatacacttgaaaaaatgtatatttctgttgttactgtcatataagtcaatttggttaatatcattcaaatattctataactgcttgttctatcaggggctatcaggtattataaaatatagttatagtctcctctacttctgtttttaattttgttagtttttgcttcacatgttttaaggccacgctattatgtgtatgcagatttagaattttatacctttctgttgaattgattcttatgattataaaatgtcccctttattctccaataatacactttgtcttaaagtctttttctgatattttatatattttaatgttattatatttggttactgtctacatagtatatatttttatattctttattgtcattagttatgtgattttatgcaaaagatatacctcataagcaatatatgtgtgtttttgtacatatgtttggatgtatatatgtattgtatatacatatacataatacacataaatacacacacacacacacacacacacacacacacacacatatatatatatatttttactactctgataaccatagacttttgttggggtacctcttccactcacatttaaggtaatttttaatatatttgcctttaaatctaccatgtaactatttgtgttttttgtccattgttatgtttgttctttgttgttttctctcttttcttgtctcatttttgataaagcatgtttaaaaaattattttatttcttattagcttgttaataactctattattttatattctctttttaattattttagagcaccgttcaatacagtaactgctagccacatggagctatttaaattaaacttaagtaaaggtaaaaattcagtttcttagtcacactggccacatttcaagtgctcaatagccacatgtggctaagggttattgtttagaagagcgtggattatggaatatgtccattattgcaaaaattctatttaatagtgccaccctaaggattacaacatgtgtttttgatccattacagtatactttaaattagtattctttctatttcttggacaatgcaagatcaacacaactttatttaattccttcttgctttttgaaaggctcatgaaatttaatcatttaaatattttgtccccatgtggcattatttttatatttaaacaaccaacgctaattcagagttccttaaatatttatcctttttggtagtcttcatttctccatgcataattgtgtttctttttgtgataattttttacctatctgtagtattccctttcatatttcttttattgaaggactgctggtgatgacctttttcagtttatttttgcttgaaaatatctttatgttaagtttattttcgagtgttggtgagttaaaaattctaagttggccattattttcttactgtactttaataatattgcaacattgtcacataaattcttatcttctgcactcacaaatccacccagattcaacagagggactatggactgcgcttctgaatgaaaagaatgtcaaaattatattggaagaagggcatgtgaaatagaataggttggagccatttttagaaaatataatctgcctcagtaccctcctgttattatttaaattcagttagtatctgtggtgatttctctctctttcaaaattccagatataggtaaactcatgtcatgggggtttgttgtacagatgatttcatctcccaggtattaagtccagtacccagtagttagttatcttttctgctcctctctctgctcccagactccaccctcatgtagaccccagggtctgttgttcctttccttgtgttcatgagtttttatcatttagctctcacttataagcgagaacatttaatatttggttttctgtccctgtgttagtttgctaaggatagcaaaccttcacatgtacccctgaacctaaagtaaaagtaaagaaaattagaaagctttttaagatgaaaacattgatgcctaaagaaactaagcaatttgcccagacagtatgcgatagagctgggattcgaacccaggttgacaaaccataaagcaaatacaactttacagtattgtatcttaagaattgtcattacaaataaaatctataaaatatttattctcaccaaaaattccagatattagtaatttgtactatctatatgttttggctccatattcccagaggtttattcatttcattatttttttcaaataaagagcttttgattttttaatctttctcattgtgtttccttcaatatctggtttatgggtattatttatttccctcactgttctttttttccccatataattcagactgggtaatttctgctgacctctctgcacactcatttatgctttccctagccacacttgccttgtggccatatttcatagacgtcagatattttcccatttagggctttgcatagatttttccctccaaaatattaacatagtgtattagtccattttcacattgctataaagaaatatccaagactgggtaatttacaaaaaagagctttaatgaagtcacagttccacatggctggggaggccttgggaaacttacaatcattgcagaaggggaagcaggcacatcttacacggtggcaggagagagggaaagtgtgaaggaggaactgtcaaactcctataaaaccatcagatcttgtgagaactcactattatgagaattgcgtggaggaaaccacccccataattcgatcacctcccaccaggtatctcccttgacatgtggggtttatggggataataattagagatgatatttgggtggggacacagaatcaaaacatgtcacatagcttaaccttctcatctcaaatatttgcccaaatgtcactttctcaaagaagactctactgacaacccttaaacttagtcatctctgattagcctaaaaaaagagcaatctgccctcagtccctgtgttctctttcttctttgttctatctttaatttttctcataaaatttattattttctgtaatgtcataatatttgcttttttatttttagtgcttccttcatgatgattcttttctgcagtctaaactccttaagtaaggtgcacttagtatgttttagtcactcatgtagcccaagtgcctagaacattgccatctcaaagtaagtgcttgttaagtccttgttgaataaatgaaaaaatttcctcttgtatcttcctgaaactaacattttcacattgaaaatatattctccctactgttatcaccaaagaagatcttggagttgttgggtccgggagatgtacaatacatggagtcctgatgtaattgcataataacaccatacagtgactttacagactggtcaaggctggaatttggaatttcctcctcctctgagcctctgtagcatttagctctgaaatttttatagtttttattgcataatatttatagcaattaagttttgtcaggactagaggcttatataaatttttcaaaagtctctcagtgtgcatcactgaaatgaatggcttttaagagctcatacaggagctggttggcatctcaaagccctctggataattcccatagaccacctcagccagcaggagtgatgttggtgattctcaaaaagtttatctggaagctgctttgaaactcatatgtgctgaaatatctgccgaaatatctgcctacagccgcttccaacaataatggattcttattttcttcctctttctaaatcagaaaatttatttggaaataaactttccctctgtggagtttctctgcatttatggatttaagtgtatatacataattgtagtaattattattccctcacatatctcaaattagttttctatctttccaattgttgataattttctatttatactttttcattaaactaattaataattatgaattttaaaatttattctgcttttatgtctgaatcttggctagagtccaaattgggtaataatcagactaccaaaaattccctctgcaatttgaatgagaagtgttgttctctattttgtctgctaaagttcttttcttggggttgctgggtgaaagtgacaattctatcatatatgaaaggtgacatttcatttgtatttattcaatgtaatccattcactgttgtaaaaatgagaactgcttcttgctaccacataacagaaggatgcagattatttcattgccattagcagtgcaagttaataatgttattgccattgagtcttatgcctaaaagtggggcacaggtcggaaaagaggaaataagttggtatgtggaaaagaaatggcattctttgctgccattttttcccattgaagatagtaatctatctctctagtgaagtatgttaactgatgtatttgaattttacttttgcttaatcctacatgagggagacattaaaatagcagtgagtacttttaatctactcacagtctttctaacatgtaacattggaagctgtatcactacaggcaattacaaaaaaaaaagcttctaactgcccaattctaaagatatgaatgtcatttctgttactttgccagaataatgaccccaattcagaacactgtggtattcttttgacatcactaagcctagaggattttttaaaagtaaggtttattgaggtatgatttacatataatataattcacccattttagtatacacttttatgagttttgacaaatgcacatagttacgtaactatcactaaaattaagaataaagaatagctccattataccaaaaaatttcttgcacgtctttgtggtcacccttttcttcgatcctcagctcctgtgaaacattgatctggctttcttttccctatagcttgccttttaggtaatataatataaatgaaatcatacagtatgtagccttttgagttgggcttctttcatttaacataatacatttgatgtccatctgtgttgttggggtattagcagtttgttctatttagcttccagtttaaatgacagaatcagcaagtgttgcttgttcaaactcagataaagctggtttataagtagaaaatacatagatacctactcttaaatccttgagcataagatctgtttcactgggagctcacagaagaataaaactttagaaaaagcaatgcaattaaattagttacataaactaaatttaaaaactataaatatattcattttatcttttcaggtgaaagtaatgcctttaaaagttcaggctagtgaatatacaatctataaaaagcacctgagtctgtcaggaattgttttatttcctgcataccttcaggaaaatttcggtttaagtgattgaaaattaaacatataccagagtaattattgctctactaaatttcaaagaaattgattgttcaccattctttacaaagtggtaccctaatttcattccttaatcccatatcatctggttgtaagagtgtacaatgccagtcacgtgataatatctaattaaacttatatacgaccataacttttagtataacaaacaggcattaaagttttaattgtaataccatatatgtatcatttttccagttgtgttttgttggttgatcccatcaagtatgtgatatgaagtatatttcatccctaataatttcaatgaggttctaatacattgatcagatttttaaatatattatatttaaaccaaaaaggcacattatcttacattttaatggaattttagaatttttatgctgtgttgtgggattataggattataaggtattttcttttctcctcaaaagcaagaccttaccgtttaattgaagagctcaaacagctcaagtagagaaaaatagtatatttgaaaaagaaatctatataaaagaattttcttaccatgatgagatagactaaaaaacaaaaaccctttgagtggtctcatcccactgtagtatcaaaccattttgcaatgcatcttttccttttttgttctcttgctgacagcccttgtgtattttatttgtatgcaagtgaatggcagtttattgtgtcccggaggatagggtattaatgatcatttgcttcctgctgtggggcctgtcataattttgtagtcagaagagtgacagaagtaacggccaatcagtatgctaatactgcttgagaatgggtagttagtccattttaaccaaggtttttctgccaaatccttaggtaattttcattaaaaaatgcaatttttgatagcattgcaaattgctagatggaacccgttgaagaaaccacatatttcttttgtgtggcagtcggacttctatctcagcaggtgtcttctagggaagaaagaaagacttctaatctgaaagcccattttggtcagcaagaatcaatgactaaaacattcagcaatttgttatatcaatatcttaacagagagaattctatgcagcatacaaaaattaaatctagtctctgacaagtaaataggatgtagaatctttaaaaatgatagttgaaagccaaatgtaaaaaatcctgcagatttatacaatgtgatatcattcattttcttctttactattctatttgtttcttccattttatgtcatttgttttttttaatgaaaggatatgcttaaaaacaataacattcaatgctagtctataaatattcaaaaattttattggcaattttacaatatacaacctatagtgagtgtactcttgactaggaaaaaaaagagtttcttaaaatgatttgtgagtgtttgcacagcacgtgaacacatgattacagaggggattagtggattaaggtatcgacagttggcagccttaaggctacagataaaaagaactccactatctctccataaaataacattttatttttacccacatgcaaacaatgccagctatgtaaactataaacagaattattttgagaatactattgtcacttaaatatgttcatcatagaaagcagaacaataataaaaacaacaaaaacttcacatatgtatataactgcatgaaatacaaggtaatatcatttaccattacaaatatgtttgaggagctctgattaaccattgagtctggagaaatagttcttttctacatattaagatttgagctgatttcaaaatgtaaacttcttaggttgtagtgataatcaatgccattgtcagaaaaatattcaatatattttaataaaaattaaatagataactatatcaaacgcaattttactttttggaaaatagagaaacaaaccttgtttgctgcctgctgtttttttatatatgcaaatctttatacatcacagaacaacctagctgccttctacaatctcataaacatttttactattttatgagatgtttgtaataaatgtgattgatgattcttttttacaattgcctattagaaataccattttgtgattaaatacttaggggtaactcaattccaagtcaggagattacaagttaagaattgacaagaatgccaaactacatgtttatctactatttattttaaatagtattttttccagtttacagagattttgcgtttcgattaattgcacacatatctaaaaatactgctagtgtggcttggctccgggaaacagcctgaagctgcaaacgcacatatagtcacaagggtgagtagctataattgtattggagtgcatccaagaaatcagctattctgtttatacttactgccgcttcaaatttatgtatatctcaagcaaacatactgtaaattgactttaatactaaaattgttgaccttgacaatgaagtttattgaccatttttcatgttgctgctatcttccaaaaattgaaaattaaggtaaatattgataatagataattaagtataatttgaaattatagtttcctccttaaggtttaaaaagcctattggcttaatgtagtaaaatacaatgcataaaaatataaaaataaaatattaatactaaggtcatttaaaatgggagtggtctactgtgaactacaattagaacagactgctcaggtatcatttgcattagcctggaaatagagttgccttatgtctaataatccaatctagtatgaatgaaggcaaattttcaatggctctaattttaggtgttggagaaacagatgctgtatttattcagatatttgctgaagtctaatttacatttgggtctgcaagctattttagttttctcttttattcaaattaccttaaaaaagagacatgttgatctgagccatattaaaacccatagcactgttgagacaaaacttaaggagtatgtgttttttttttttctgtgtatgtaatgtggaaagccttgacatattatgcgtcatggcttcttgattttattcttctggaatttgctctttatgtcttctgattgtgttttcctggaatcatcctccctggcatataaccttcagattttctttcaggtcacacttctatggaatttcatacactggtgaagtaagtcaggtccaggaataccctccttctcaggtttgtgttgcaacccagaaatcaaactgggagcttaagcaaaggaggcacaggggaggaaacaggtcagatgatagtctatgaagaagaacttctggtggctgattctgatttgtcctttttcagtagatatggccactggatttgtagtccaaagataggcattaatacattttatttctccatggatccagctgaatagaagatattacatatttcacattaaatatcttgccatttctttttcaaataacagaagattatacccattctttctgcatttacaaagagacccttttacgttctaccatggaaaaagagctaccagttagttaataagtcttttgctcaccatagtcatatattcaagataatatagtactaaaggggatcaattcttgttggatgtgaagtccattctgccattaaccagctgagtgactagggaagttagcctctttgggcatcaatatcttcatctataatttaatacaatagtgcaacttacattatttgctggttttaaagattaaagtagcaatgcatatctagcacttacaagctacttcctatatactatgtactatgtatgtaattgctattattaatactataatctatttatttggtcactcattccgtcattatatctacacaactttctaccatcttactcatgcactcattctggcactaaccaaagctctatggggaaagaatcctgcaatgtgtatacagtagggtttatgttactgaggaattaattgtctgtcagaagaattaatatggatatcaatctaaaacacataattaaaagtggtaggtacataaacaatgctgtgggtgttcagagcaataaaaataagcagaatatagttttttaattcataatgttagccactgtgatagatactttacaaatgttatttcattcaactcttgccttgagaagataattttttgcagtaaatgattagtgagataagtaataaagggctggttggatttgaatttaaggagaagtgagaaaattattccattcagagaggagcaattacactaaagcgcatagtctgggatggggaaaaactaaacagctctgtttggtgagaacacaggactcaaggaaggaaacagctgatgcatcatcacctaaggaaagtccagaataatataaagaaggtgtattagtcaattttcatgctgctgataaagatataccagagactgggaaatttacaaaacaaagaggtttaattggacttacagttccacgtggcaggggaaggtcttacaatcatggcagagggtgaaaggcacttcttacatcgtggaagcaagagagaatgagcaagaagcaaaagcagaaacccctgatgaacccatcagatctcatgagacttattcactatcatgagaatagcatgggaaagacgagcccccatgattcacttacctccccctgggtccctcccacaacacgtgggaattctgggagatacaattcaagttaagatttgaatggggacacacccaaaccatatcattccacccctggcccctccaaatctcatgtcctcacctttcaaaactgatcatgccttcccaacagtcccccaaagtcttaactcatttcagcattaacccaaacatccatagtacaaagtctcatctgagacaaggcaaatccctttcacctatgagcctgtcaaatcaaaagcaagatagttacttcctagatacaatggggtacaggcgttgggtaaatacagccattccaaatgggagaaattgacaaaaataaaggggttacagggcccatgcaagtctgaaatccagcagggcagtcacattttaaagctccaaaatgatctcctttgactccaggtctcatattcaagtcacactgatgctagaggtgtgttcctatggtcttgggcaactccccctctgtggctttgcagggtacaggctccctccaagctgcttttgcaggctggcattgagcgtctgcagcttttccaggtgcatggtgcaagctgtcggtggctctgccattctggagtctggaggaaagtggccctcttctcacagctccactaggcagtgccccagtagggactctaggtgggagctctgaactcccctttcccttctgcagtgccctagcagagattcttcatgaggaccccacctctgcagcaaacttgcctgggcatccaggcgtttccatacatctgcaatataggcagaggttcccaaacctcaattcttgacttctgtgcacctgcaggctcaacaccacgtggaagctgccaaggcttgcagcttccaccctctgaaaccacagcccaagctctatgttgacccctttcaaccacagctggagtagctgggacaacagggcaccacgggaccctgtgcccggcctacaaaaccactttttcctcttgggcctcagggcctgtgatggggaggggctgccttgaaggtctctgacatggcctggagacattttcccgatggtctttggaattaacattaggttccttgctacgtatgcaaatttctgcagctgccttgaatttctccccagaaaatgggtttttcttttctgttgcatcatcaggctgcaaattttctgaacttttttgctctgtttccattttaaattggagagcttttaacagcatccaagtcacctttggaatcctttgctgcttagaaatttcttcctccagatacactaaatcatctctctcaatttcaaagtttcaaaatttcaaagttcaaaatttcaaatctctagggcaggggcaaaatgccaccagtctctttgctaaaacattgtaaaagtcacctttgttccacttcccaacaggttccttatctccatctgagaacacttcagcatggaccttattgttcatatcactatcaacatttttgtcaaagccattcaacaagtctctaggaggttccaaactttcccacattttcctgtcttcttctgagccctccaaactgttccaacctctgcctgttacccagttccaaagtcgctttcacatttttgggtatcttttcagcaacaccccactctactgataccaatttactgtattagtccattttcatgctgctgataaagacataccagaggctgggaagaaaaagaggtttaattggacttacatttccacgttggctggggaaggtctcacaatcatgacagagagcaaaaggcacttcttacatggtggcggcaagagagaatgagcaagaagcaaaagtggaaacccctgataaacccatcagatcttttgaggcttattcactatcacgagaatagcacaggaaagaccaggccccatgattcaattacctccccctgggtccttcccacaacatgtgggaattctgggagacacaatttaagttgacatttgaatggagacatagccaaactgtataaggaggcatatcaacatatctgtaatttttattggattaacataccagaaaatatgaccatttacaaacatctgaaggataatgatatagtttatataatgcatttgattataaatattttctgccaagctagatggtgaaaaagcagttaataactttatcacttttataacatctgattttttatttgattatttatttttgagatggagtctcgcactgttgctcgggctggagcgcaatggcgtgatctcggctcactgcagcctctacctcacaggttcaaacgattctcctgcctcactctcctgagcagctgagattataggtgtctggcaccacacccagctaatttttgtatttttagaagagacgggctttcattatgttggtcaggctggtcttgaactcctgaccttgtgatccacccacagcctcccaaagtgctggtattacatgtgtgagccgccgcacctggccctgatttttaaactttttaaaaacgtgtttattggttctttttgtgagacaatttattctatgtagctcaaatttctgcatgatctggttctcccaggcaaagtactaaatagtaaaggttagacatgtctttcttcccagagacagttagggtagtaaagatagacatctccttcccttctccagagaatttgcttacaatccaagtaaataaatataagaactttctctttctccagagaggaggatggacacatcaccagcagccctatataagatcagtttcccaacttaaggactcctcctctttaatgctctccattctgtgtgtaagtaccatctggctctgaacacatcatcctgttgagactggatttcagtaatagacataaaatgttactctgactgctacttttgaaaaaggttttatgttgtttaattgataaacaataatcatatattcatggtatacaatgcaatgtttcaatacatgtatacattgtggaatgattaaatcagactaacatatctatcaccttaaacacttatcatttgtatgtgatgagagcattaaaatgcattctttagctattttgaatatgcaacttattattacctatagtcagcatgctgtgcaataaatcactagagcctattcctcccaattaattgaaactttgtaccttttgaccaacatctccccttccttatccactccctattcctagcctctggtagccacaattctgctctctacttctatgagttcaattttttttttacgattgcacattggagtgaaagttgtttctctatttgtctctctatacttggcttatttcatttgtctttctatacgtggcttatttgatttgtctttctacacctggcttatttcatttagcatagtgttctccagattcatctatgctgctgcagatgacaggatgtcttacttttaaatggcttaataaaattgcatatatatcacattttaaaattcattcatctattgatgagcattttggttgtttctatctctttgttattgtgcataacatggcaataaacatgggaatgcaaatatcactcaatgtactggtttcagttcctttggatatgtatcccagaactgagattgctgtaccatatagtaattctattttcaattttttgagtaacttctatgctactttctgaaatgacaatactaatttataatactaccagcagtatgcaagggctcccttctctctgcatccttaccatgcttatcattcgttttttaaatttattttttaattgacacattgtaattgtgtatgtttaaatggtacaatttaatgttttgataaatgtgtgcatgataggatgttcaaatcagagtagttagtatatccactagcttgtgcatttatcctttctttgtggtgagaacatctaagagacctctcttttagctattttaaagtatacaatattttactgtaaactgtcctcacctaccatgcaatacaacatcagaagttatacctcttgtctaattgtaactttgaacctgttgaacaaccaacctctcttcatcctcccctccccagactccagtatctcctgttctacactctgcttctataaaatcaactttttttagatttcacatatgagagagacaatgtagtatttctctttctgtatctggcttacttaacaaaatgtcctccaggtttatctattttttctcaataacaggatatcattcatttttatggccaagtaatattccattttgtatatatacaacattctctttttcatgtatgcattgttgaggatttaggttgattccaagtcttggctattgtggatggtgttgccacgaacatggaagtgcagaaatgtctttgacatacttatttcacttcctgaggatatatacccagaagtgagattgttggatcatatggtagttctatttgtaattttttggggaaactccatgttgttttccataatggttgtactaattttcattcccaccaaaagtgtgtaaggatttccttttctttacattttcactgaaatttatctttttgtctttttgataatagttatttttactagagggaggtggtatcctattttggttttgatttccatttccctcaaaattactggtgatgggcgttttcttagatgcctattctttcgagaaatgtctattaagctattttaatctgaatcttttctcttttttcttagtctaggtttaataaaagtttgttattcttgtttatttttaaaaaaaaaaaccaactcattttgttgatattttaaattatttttctagtctctattttatgtttgctctgagctttattattttcccccttctgtgaattttggactcagtttgttcttgttttttttttttatttcattttattttatttcttcaatgcctagttaggctttgtattagatttttttttttgatgtaggtgtttatcaccatattgttttgctatgtcccataggttttaatatgatgtatttttattctaatttgtctgcataatttttaaaatttctttattgacccattggtcatttaggagcattttgtttagtttccatgtatttgcaaagtttccgattttttttgctgattttctatgtatttgcattttcgatgtatttgcaaagtttccaatttttcttgctgatatcattgtattcagaaaagacacttggcacaatttctttttataatatctttttaaatttgttaaacttatttcttggtctaacatgatttatctcggaaaatgtttcatgtgcagttgaaaagaatgtgtattctgcagctgttggacacaatgttctgtaaatagttattaagtcaatgtagtctaaggtgcagtgtaagtctgatgttttttgtattgtctgtctgtttgcatgacttttctattgttgaaaatggcgtgatgaagttctcccattattatgttgtatttgacctctctctaaatatgaaactattaaaatagtttcttattatgcttgggtgttctgatgttgggtgcatatatacttattatatcctcttgttgaattgatcaatttatcattatataataacactttttgtctcttttttacagtttttgagttaaagtgtgtattatttgatacaagtatatgctattcctgcttgttttttatttctgcttgcatggtgtatctttttctatccttttatttttagtctctgtttgtctttaatggtgaggtgagtttcctgtagcgagtatatagttggatattctttatttgtccattcagctactctatatttttaattggataatttaatccatttacatttaaggttattatttctgagtaagaatttgcttctgccatcttgttaattgttttctggttgttttgtagatcctctgttcctttcttcctctcctgttgtttacctttgtggtttggtggtttgctgtgctgctaagctttgattcctttctctttcttgtttgtatacctgctttaatttcttagtggttgtcatggggctaacattaagaagcttgtggttataatagactattttaagttgatagcaacttaactttgattgcataaaaattttctagatttttcctaccccacacaattatatgtttgttgtctgaattagcactttatctggtgtgtgttctttaacttctaattatagctgttgttcctcttaattgttgtgacttttaaccatgagaggattgaaacgtttataaagcacaattataacactgaggtgttctgattttcattataaatttacatcaactggtgagtttcatatgtatattcataagagtaattattgttcttttgtttcaagttgttgcatttccttaagtacttcttgtcaggctagtctaatgatgatgaattttctcagctttttattgactggaaagttctttatttctcttttatttctgaataatagctttactgaatgtagtattcttggctaacaggtttttttttttctttcagtactttgaatatataatctctttctctcttggcctagaaagtttctgctgagaaatctgctgatagtttaactgagatttccttttatgccacttgacacttatgtcttatagcttttaacattctctctttgtttctttgacttttaagttggattattgtatgccttagagagagtctttttgtattgaatctaattggggatttttgaacttcctagatctggatgtccatattttcttgacttgacattttcagcattattttattaaatatgttttctatgatttgctctgtcctttcttcctctgacattctcataatgccataatttgttttcttaatagtgttccataagtttcatagtctttctttaaaaaaagaagtttcttcttctttttcccctctgactggaatatttcaaaataccttcttgaagttcagaaattatttcttctgcttgatctagtctgtttaagctatcaattgtatttcttattttattcattcaactattcagctctaagatttctgcttagttctttttaattatccttatctctttgctaaatttctcctttagatcataattgtttttctgatttcagtaaattattcttcggtatcttgtaccttgctaagttttgttaagatcattattttgaattcctcttcaggcaatttgtaatttattttacttctgggtctactattggggaattattgtgttctttatggggtgtgatgtttccttggttctcatgtttcttgtgttcctacatgatgtctgtgcatctagtggaacaatcaccttttccaatgttatgaagcaggttttgtagagaaagactttctcccggagaggatacctagggtgttggttgggtacggtatgttggtttgagttttgaatatactcaatagtgtggtctctgtgaagtatcttcggatgcgattcttgttagcaatgtctgtcactgcctagtggcctaggctgtgggaatttgtggtgatagtggcatagctttgctggaggtgtaggcaccagtctggctgtcagtctggatgtatacatgtggggcaggccaactggctgtgcagtttggtatctgggaattttagtcacccataggtatgctgttcagccaggcatgcgtgcaaacacatacagcaagccagccgattgtgcaatgggctctcaagacagtgagcttctgctaaactggctcttgggccaggtgcaagaacatgtggctgcagatgcagcaggccagtctgctataaggtgggtccttattttttcataataagcaatctatcaggtttgaggtaatattttatttttgttttaattttcatatctctgatgattggagatgttgaacttgcacatatatatgtatatatctgttggccattcatatgtcttattttgagaagtgtctattcaagaccttgattttttgaatgatgcccactcacattggtgagagtggatcttctttactcaggctgatggttccaatgctaatctttttcagaaatgtactctgatacaatcagaaataatatttcactagctacatgggtgtcccttaactcaatcaagttgacacataaaattaaaccatcacacccacccattgtcaacttgacacctatacaaatttccttaaaccatagtcagtttacaaataaatataataacaaggtcataatctgaccaaacatgacacaactatcctgtgcataactaaaaacataccaatctcttccttagtagaggaggtaaagcccttgagtgatgtttcctctttccttgatatcccataacttaagcactaaggcatgaaattaataatacttgcataccaaaatgaaatcaatgcattttatgttatatgataagggactaagagaagaaagagaaagaaaacaaaattatttgcttaatgtgtatatacatatatatgtatatatatatagttctaacaaaataaggaggaaatactcatggcaattacagtcctccatagtcatagctggtatttgtaactaccttatttctaaggtggttttgtattaacttccaggtcattggagtcattgctgtgtctcctgggggaagcatccccactttggaactaagacttttaggccacaagaacataaagtcatgggaacagaaagcaaaaattttgctagggagtctcaaggggtaatagtgagttgtgcctctcacattttcaccatttgattcctggacctgtgaatcctggctatcagagaaaagtaccttgtattaaacagcaattcagagcacatacagccttctggagaatcttttctcagccctgaaagatgttgccacctagctcatgctatgactaggtcttcaaagcgccattccactgttctgtcaagccagctgcttcaggatggtgaagaacatgataaaaccagagaattccatgagcatataggcatatcactactctccttttactctgaagtgagttccttgatcaggagcaaggctgtatggaataacttgatggggaataagactttctacaagtcaatgatggtagttttggcagaagcatttcatgtaggaagacaaatgtgtacccagattaaatgtctattccagtaaggacaaaacattgtttcttccatggtggaagtgttccaacataatcaacctgtcaccaggtagcaggctgatcatgccagggaattgtgccatattaagggctcagtgttggtttctgctgttggaagattgggcgctcagcagctgtcataggcaggttggctttagtgagctcaaatccatgtcactaagcctgtgtataaccactatccctcccaccatggacactttgtccatgagctcattgggtaatgacaaggattcctgggaaaacaagctacttagcatcacagagtaggtcaacctattcatctgattatcaaaatactcctctgctgagatcaccatttaacaggtattcacatgggacacaaatattttccaattttttgcctatttgagagctatctctcaaaaaaacagtagttacctatagatgatggcaaggccttccttcaaaatcctgaaggtttgtactacaatttgcctataggtgcctatcaaaggccttaaacatccatggaaattttaagcactaatggatctgctgaatcatataagcccacgtggcagagcagcttacacagcagcctggacctgttgcagagccttctcttgttctaggtccaacacaaagctagtagctttttaggtcacttggtaaatgggtcagagtgatccaaccaaatgaggaatatgttgcctctaaagctcaattaggcccaccattgtgcttctttcttggtcatagggggttccagatgcaacaacttttctttcacctaagaaggaatatctcaacatgcataacctcagtgaactcctatatattttactgagatagaaagcccctgtattttagtatgatttatttcccaccctatgatatacaaatgtcttaccagtaattctagtgtagtttctacccctcattcactaggtctggtcagcttaatgtcatcaatgtaatggactagtgtgatatcttgtgcaagggaaaagcgatccaggtctatgcagagtagatgttgacataggataggatagttaatatatccttgaggtgggaaaataaagcggaatttctggtcttaccagctgaaagccaactatttctggtgggtcttatggacaagggtggagaaaaaggtttatttgccaaattaatagctgcatatcaggtaccagggtatgtgctcatttgctcaagcaataaaaccacatcgggtacagaagctgcaactggagtcaacagttagttaaactcatgatatttcactgccattgtccaagatccatctttctctgcacaaggtaaatagaagagttgaatgaggttggggtgaaaacccactcctggatctttcaagtctttgatggtggcactaatttctgtagtccctcaagagatatgtgtactgcttttggcttactgttttcctaggcagaggcagttctaatgatttccatttggtctttcccaccatagcagccctcagtctacagatcagcaaatcagtgtggggattctgtcagctgctaagtatgtctattccaactatgcatctggaactagggaaataactatagggtgggcttggggaccctctagccccactatatgacagatctgagctaaaactacattgatcatctgacctccataagcccctactctgaatataggaccagagtgatggtttgagtctcctggaatcaatgccaatagttcagtgtctagtagtactcagaaggtctgattatttctctccctctaacccacttaccctggtaaaaagctgtaagattaatataaatttttggtagtttaacatgggtcttactcaatgtgacccagcatcctcttcatcaagaccttctaagtctgtaaactggcttaaatctggtaattgaataatgtgccatgactctcttcttttataattagacttaagacttttgttaagcagatctggaacttttctgcttatacagatctaggcttcctgtttattttacatctagaaacattatgattagctagccaattccataagtaagcatgagccagactatcctgattgctgctttgactctgctgtttattacagtacctatgcccatcttgtcttcgttggttgagtgttgccactctgagatccatctacccacagtgcatataggttttccaattgaatggctgcagttcctgctctaaggtctagcctaccaaggaaagtgatcacaaagctcttgaaagattctggggctcctttcacaaatttattgtttgaagtattggtaaaaagatgagtcttctgaacactccagtatgggtaagtatgtcttaaatgacaaattcactctaacattacaatatccctaaggctttgaatcccttctttttcattaaaccaatgaatcctgggcatttctaattttttcacattttttttcatccacacttcaaccaaacaaccaaacgaactggttagagtcctttctaactccctgtgtgcagaaatctctgcttaatgggcctatattaataaattttacctgttccaactttgtttcttccaccattatcccacaccattaatatttttccctatagaagttccttgtgtttctgcttctataaagtagaaaattcaagttgttcttttggggtgtagtatacctcttcaagggtcacactttgtgtctcacctttaggaacaagctgaggcttgagtcccattataggtttagaagtaaagaaagatagtgggtgagtcctgaggagagtcagcattatcttcatactagctgcctcagggaaggccattgccttttccttaggctatgcagggttaactccttcagatggcagtgcgaaggcaacatcactatgggtggagaggtcactgcttctagggaaagggacatcctgtttgtctgctggtgttggaaagccacttttgctaggggaggataaaccactttcattggggatagataggccatctttgccggggttggggaggcctcttctggcaaaaaagactcatcagaatttaggggcttaatgtccccatcatcatcacaatctcctcacacattctcatcccaacttataggatcccattccttcccaatcaatgccctcactttagcaataaataccttgtaatgctgggagttcaacttgaattgtaattcagccaatcacaggatgatgtcctgacttttattttcagccatttcagccctgtgactctccctcagggcatacatacaaactcttagatcatttatgggtacttgaactggaatgcaaatccctgagctcatccttgtctattagcactttgtctagtgacattagtggcaaccaatcaatgtcattaaattatttagttttccacaaatgtttgaaagtatattcaaagttacttatctccctgcttcttgtaagtggttaattataagtatttaatgcagatattttgtgtgcttctataaatagttcatgccaagaactatcagtgctctctttactattggaaacagagtcattagaatctttaaatctaatcagattagaaagccattttcagaagcccaaaaccaattcagaaaaggtcatctgtttttctagaattgctctcattaccaaagtctgcattagtcagggttctccagacaaacagaaccagtaatatatatatatatatacacacagagagagagagagaaattaattatggaaattgggtgacatgattatgagggtgaagaagtcccaagatatgccatctttaagagaactaggaaagtcagtggtgtaactgggtctgagtgtgaaattccatgaacaaggaggccactggtataagtgttaagtcctggagtctgaagactcaagaatcaagagctctgatttccaagggcagtgtaagatggatatttcaattcaaacacagagagagaattcaccattcctccacagataggaagatgtccggtcacataaatgaggatgaatatcctttactcagtttacctactcaaagctaaactctttaggaaccctcatagacatactcataaataatgttttaccagctatctgggcatccctctgctctgtcaagttgacacataaaattaaccatcacgagaagagagagtaaagggagataaaaataatatgtgttaagccattcttacattgctataaaggaatgcttgagactgggtaatttataagaaaaagatttaattggttcacggttctgcaggctgttcaggaagcatggtgccagcatctgctcctggggaagcctcaagaagctttcagttatggcagaaggcaaagggggagcaggcacatcacatggcagaagcaggagcaagagagagataaagtggagggggaggtaccacacacttttttaaaagaccagctcttttgagaactcactcactatcaagaagacaacaccaagccatgaggtatctgaccccatgatccaatcacctccacctccaacattgaggattacaattgtatatgacatttaggtggaagcaaatacccaaactatataataataattaataattttaaaagatacctttattattattttttttgggggcgggggacagagtttcacactgtcgcccaggctggagtgcggtggtgcgatctcggctcactgcaacttctgcctctcgggttccagtgattctcctgcctcagcctcccaagtagctgggattacaggcgcccaccaccatgcctggctaaaaatttttttttttgtatttttagtagaggcggggtttcactatgttggtcaggctggtttccaactcctgacctcgtgatccacccacgttggcccccaaagtgctgagattacatgcgttagccacagcgcccagccttaaagatagctttatatatagtgattagggagcatgaataattaaaatcttactggcgattattttaagatggcaggtatttaactgatttttactttcctttttatatcttcaaacagtttttgactttttataatgtgtatatgtttttcataatcaggaacacttgcagctcttttcctgatgggaggagaagtacaagcctcagcaaaaaatcgtgtcttagaactcttgataccattgtactttaacatcacataacaaagaccctaatatcattaaacatcacttataactaaccttcccctgtatgtcattctgcagaggaagaatcagctgcttatgtttacataaggctgccattcagtgggagttgtccttctcctgtatttctctctggcagtgtagtagcaattaaatgccttgtgagtaagaaactgaaaaaaaaatcctgtttcttaggttatagagccaaagttcctatcttgatacaataaaattgtaaagataaatagcatattctgaggttgtcagccattcagcatcttctaataacattttttcctttatctgcattttcttttgcaccctaacacacccattacttccttcatcctttctttgaccattctccaattaaacttgagataaagctaatgagtctctttaattaaatctatagtccagaccactctcctgagttccagaactcttttattcaaaagttttactcgatatctatattagtccattctcacactgttataaagaactgcccaagactggataatatataaaggaaagaggtttaattgtgtattagtcagggttctctagaacgacagaattaatagaatatatgtatatatgaaagaaagtttattaaggagaattgactcacacaataacaaggtaaagtcccacaataggctgtctgcaagttgaagagcaagaaagccagtggtggatcagtccgagttccaaaacctgaaaagtagggaagctgacagtgaaaccttcagtctgtgtccaaaggctggagaatccctgggaaaccacttttgtaaatctaagaatccaaaagctgaagaacctggagtctgttcaagggaaggaagtatccagcatggtagaaagacaaaggccaaaagactcagcaagtgtactcttccatcttctcctgcctgctttattctagctgtgctggctgctgattagatggtgcccacccagattgagggtgggtctgcctctcacagtcctctgactcaaatgttaatctcctttggcaacaccctcacagacacacccaggaacaatactttgcatccttcaatccaatcaaggtgacactcaatattaaccatcacaaattgactcactgttccacagggctggggagaccttaggaaacttacagtcatggcagaaggggaaacaaacacttccttcttcatgtggtggcaggaaggagaagaatgagcaaagagggacaagctccttataaaaccatcaaatctcatgagaactcacttattatcttaagaacctcagcctgtgggtaaccacccctattattcaattacctcccactgggtgcctcccatgacacatggggactatgggaattacaattcaagatgagatttgggtggggacacagccaaaccatatcaatgtctgttcttggatgcttcaaaatcctatacatcaaaaacaaacaaaaaaaccaggaacaataaaacaaacaaacaaacaaacactgatctctcatcttattaccagctctcaaatattgttctccagaatttccagattcagtgaaaggtatcatcaggtgaacaaggtagaaaactaggagttatttttgtatatagtggttgtcatctcttctcacattcaatcccctgactgttgttttgatttcttaaccaaaacatctctcaaattaatctgtttctacttcatctgtactgctaacacggcatattagtccacattatcaccatctctcacttgaatattctctgttcttttgtgtgatggtcagtcaggtgtggacaaaaaggaaacacagaagatgtgcaggaaaacagaagtttattatacttacagattctagaaacaggaggcacagcacactatgcaaggccacatggggaggcctcagtgtagttaagaggcagaaaataggagcaaggagaaagcctaggccgaacatttattgggctttctcagggaaaggtgtcacaacaggatagtttaggatgggctagtttgaatttcaactgactctaagctattgggaggatccctagttgcctggtacctggcctggcaggattaaggcagagaaatattgcctcctgaggtgtattggccagatagagaagatatggccttggattcgttggtctgcatattaaggcatgctccaggagtggaaaggtcagggagtcatctttcttctggcccagtggcagagcatgcctggaaaggagagaaaagacaaaagagccatgagaccgacagcctacctatgggccattactcttaaccaccatctactggatcacagcccaaactacaccaccaaaaaaatactctgctactatacacccctgtgaaaccaagggtaagaatctagccacaaacaaagatgctgtacagactcttgaccttctgaaagtatccagaaatgaagccaattgactatactcaacttattcaacttacgctttcacaattaaaggaacaccagccctccaagatgagaaagagtcagtgtaagaattctggcaattcaaaaaatcagagtgccctctcacctccaaacaagcccacttgttccccagcgatggttcttagccagactgaaatgactaaaatggcagacataaaatttagaatctggatggcaaagaagctcattgagattcaggagaaagttgaaacccaatccaaggaatacaagggatctagtaaaacaacccaagaactgaaagacaaaacagccattttaagaaagaacatagccttgaagttgcatgttataaaatatatataatatatagctatataatatataatatattaatatataatatatgatatgtgtatatatattatatatgaacaaaactgaactgctggaactgaaaaaattcactacaagaagtttataatacaattggaaatactaacagcagaatagagcaagctgaggaaagaatcgcagagcttgaagccttgaagactgtatgaatcagttcagttagataaaaataaagaaaaagaattaaaaaataaacaaaaccttcaagaaatatgggattatgtaaagagatcaaacctacagctcattggcattcctgatagaggagagagtaagcaaggtgggaaatacatgtgagaatacaggccattaaaatttccctcatcaagctagagaggcagatgtgcaaattcaataaatacagggaacccctgtgatactatactctggggggtctccaacccccagcactggtctgccgcccgttgggaaggaggccacagagcaggaggcgagtggtggcaagctagctttactgccttagctccgccccctgtcagatcagcagaggcattagattctcataggagggccaaccctattgtatgcgcatgtgagggatctaggttgcatgctccttatgagaatctaatgataaatgtaatgtgcttgaatttttccaagaccatccccatcctttggtctgtggaaaaattgtcttccacggaaccagtccctagtgccaaaaaggttggggaccaatgctatacaagacgactttccccaaaggacacagccatcatattcaccaaggtcaatggtgtggcacttgcaattcatttgtcaggtgttctgggcagtggtttcccctgggtagtggcctcagcagggagatacgccccatccttcccagattggccctgagaagggaagtaggctccacttccacaccattccacaaacctgcccttctcactcctctcagtgctctgagagtgggggctcctctcctacataagtgcagaccacagatcctagctcaacactcccaacctatgtccccagcctggaggctccgggactggcctgcagcttggggttgagttccagatgccctatggaatttaaaatgctctcaggtcaccaggaaagtattcagttgccccaaagcacccagactggacaatggaggctgcactgtgcacatatccctgcaggatggccagtcaggggacctgggaggggctgactaggaggagggccttcagaataagcatgcccttgtctgatggggaagtcaatcctgctctctctttgcctgcagtcaactggagccagaacttctcagagggagatggggagtcctggtggatgtgtgcctatggccaccctctgccagagctgctccgtgcttaaaagcccctgggctccaagtgggctgaagccctacctctacctactctccaggcacatcctcctgccagctcaaacacccatggaagaagtgggggctctgtagctaggatcccagaggtctgtagtgagagtgagctgtatatcagtcccttcattcactccttgcctgggagctgttgaaggccaggaactagccctagcattcaggtaccccaatgttcccagcttcctccctcttcagcctctgagtctgcattgcttctccatccgctccaggtaatttctctctgaagatatgcttaaattacgttggtttattggatattttggtctctctcagtggaagcagcacttcctggctatgtctagttggccatcttatccccttcttttaatttgatgattttgtaatattacatttgaagattctaaatccaagtctcttttttcctataaatgtcagttatatttacgttttctataaatgcagattataaatagcctaaatcttgaaatagatacaaaagttaagcaaatgtgatataatattaggttggtgcaaacataattgccgtttttgccattacatgcaaaaaccacaattatgtttgcacctatataaatatataggaatgaaaaaaataaatagaaaattatattgaagaaagatatgcaaatgaatataaggcagtttcatagaagttcctgggggaaattttgcatttatatataaatgcaaatgtctatatatattccacaacatctaggataaggatttccacttagtggagagtcagtcctatgcaattaattgaatgtcttatctcaaataacttttgcaagaaattagcatttagtatacaagcactacattttgagccagttatttttttacctcttcaaataatcaaatgaatgaaatcaagtaaggactctcatatatgaggactataaataacatattactacagcaatgcgtattttttcaagattatttaaatgtgaacacatttgtccctattaaaaaaagtcaatttagacttaacaaattaacttgggagaacatcagatcaaatttactaggttcattaagcttagggaattaaatttcagaaatctctattttcgagtaatagattctaaaagtaatatttagcagcctgtcaaatatgtgcttctttatcatgtaaattgacattagagatcaggaaaagagactagtattagtttttctctttctagattcaccatgtgtttataatttaaaattttaagaaaatagtaatgagcatgaatcctctataacttcagctttacgaaaatctaaaagcacaattttgttgctctattaccattctagattcaccagctgtttcttgattggttgtatagctactagattgcattacttaccacaaaattacaaatatttgtataatattggttttcgtattaagaacacacagaattctttttgagtttttcttcagtttcctgaattttgtgacagaagcaataaatacagaggaagttattattgttatgtagtatttttaaattattattatgttttagagtcagagtcttactgtcacccaggatggagtatagtggtaccaccatagttcactgcagccccaaactcctgagctcaagcaatcctccagcctcagccttctgagtagctgggacaaaagtcatgtgccaccatgcctggctaatttttttgttatttttttagagacagggtcttgctttggtgcccagtctggtctcaaacccctggctttaagtggtcctctcaccttggcctcccatcgtgctgggattacaagcctgagccacagcaccgtttctagtagtattctgatggattttaaagtaactctgagagtgtaagaaattaaaatagcatgcaagtggaaattatatttatgtttaaaaataaagagacacacataatgaaatcacaaaggccttactgtctgtcaagggcacagatagataacggtactcaatcacagtatttctgtttttagtcatagctctttcagttgtcatttcctttatgggaaactattgactagattgtgaaatgctaagacgggtgtgacattcttatcttcctaaaaagcagttgttgtgattttatcttgacattgcctccttttcacttactttctctttctttgattagacattgcctatatctaaaataactagaatttactggctcctaaatataaatattttttatttgtgatacctgaatcaatgcatttcaaataaaaatcagttagaagacaacataattttaaaaatggcaccagatgttataaagttctggccggttggactgtataaattggggcttctaagtgcaactccacctcaaaatgacaaacaaaacttgtagtaataatttttcaatatccatttttatccaaggttttctggttttagagagaagttgataattatttttcatcattcactctttagataaaagccatgaaatatggtagagtgaactggtgtagaaagtctaggaaatgaactgcatatgacatgatatagaatgacagactgtttcagtatttcatatattcatttgaatagtaagactttacctttccttaaaatcactatttatgaattaccttttcttctggcatgtgactaaacattatcaaacttgaaggtagatacataactggactcattggaaaatgttccatttcagtggaagtgtaggttgtcagtggccagccatctcttttcttgcttcttagatgcatgtccgtgattgcaataagtttggctacccccaacccatggtagctacaaaggtgtgtttgtgtgtgtgtgtgtgtgtgtgtgttgtgtgagtgtgttgtgatcaggggttgggagttagggaatatgagcattgtggaatccatgtaagatagcatcatatctttttcagtaaaatgtcatagagtataaaagatattcatgatttaggtatcatctaagtcattcatgttgccttgttcctgtcctggcagttatcagagtatcttacaacatgccctgcatctagtttttctcttaatatatacacgcgtgccctcttgggaaacaattttgtacacacaggggccaatataacactcaaattatgtcaggtttttttggtttttttgttttttgttttttggaggtaatgtggcacagtgaacaaagcacaatctagacgtagactcaagacacacaacttcatagctgtgtgaatttagatttgtcatttagctccccaagtcaaatttgcctctctatataatggtaattagtggtacttctcttaagccgtatatatcttagtggttatatatgcaggcacatgcagaaaatactgtggtttctattccagaccaccacgataaagtgaatgtcacaataaagatagtcacacaaatagttaggtttcccggtgcatataaaagttttgtttacactatactatagtctgtaagtgtataataacattatgtctgaaaacaatgtatgtatttaaagtagtttagtgctaaaaaaaatactatcaattatcttagcctttagtgagtcataatcacttcgcttgtggaggattttgcctcaatgttgataattcctacctgatcagggtggtagttgctgaagatttaggtggctatggcaatttcttaagacaagacagcaatgaatgttgctgcatagattgtcttttcctttcaagaaacttatctctgtagcatgcaatgttgtttgatagcattttgcctagaggaattctttcaaaattggagtcaattctttcaaaccctattgctgctttttcaactatgtttatgtaatattttgaatgctttgttgtcatttcaataacgttcacagcatcttcactaggattagattccatctcatggaatacattttatttgcgcgtttgtaagaagcaactcctcatctgtttaagtttttttttttttttttgatgctgatttttttttttaattatactttaagttttagggtactgtttaagttttatcatgagattgcagcaattcagtcacattttcaggctccacttctaactatcttgttatccaccacatctgcagttacttcctccactgaagttttgaatccctcaaattcatttatgagtgttagagtcagcctcctccaaactttcattaatggtgacattttgatctcctccaatgaatggagtggtcttaatgacatccagaataaagctgctttacgttctcatcatttgtgtgttcactgaagtagcatttttaatttccttttagaacttttcctttgccttcacaacatggctgactggtgcaagaggcctttctttcagcctctctcgactttcaacaagacttcctcactaagcttaattatttctggcttttgctttaaagtgagagacatgcaactcttcctttcatttggacacttagagggcattttagggttattaactgacatattttcaataatgttgtgtcagggaataacgaggtctgaggagaaggaacaagatggtggaatggccagttggtagcatagttagaacacacacattcatcagttatgtttgacatcttatataggcacagttcatggctaccctaaataaatacaagagtaacatcaaaaatcactaatctcagatcaccactgcaaatataataacaatgaaaaagtttgaaatattgtgagaattacaaaaatgtgatacagagacacaaagtgagctcatgctgttggaaatatgacacctgtagtattgccacaaaccttcaatttgtaggaaaaaaaagaaagaaaaaaaacctataaagtgcaagaaagcaaagcacaaaaggtgagtcattcctgtatttaaaaaatcaggcatataatgagaaatgacttattaattgttatatctattattgaaaacaaaggccattttatttgtggggatcatgaacgagtgctacattgattgcagcagttttcccatatgtttctacaacctcgttctcatggactattaggaatctacagatctgtgcctatctgttgtcattttgaatttcctttattctgtgtgtctatgtgcatagaagcatgagtgtaaatgtatatttgtatttagtagttatcaatctcttgctttttacccaactggagtagatattacattttaaaaatcatgcaaaaatctggccatatattaatatattattattttttaaaaacctgattaagtgattattgaacatttaaaaggagcctatcatagatctcagtgtttaaattttataaatatttgaaaattcaaatatgccttttatataccacttcggatacatcatttctctcaattattctaaacatcttcttttttgaattttctatggtctgaatgtttatgttgcctaaaaattcatatgcggaaatcttcactctcaaagtaatggtattaggagcatagccctcatgaatgagattcatgcccttacaaaggatgcccccttcaccattttgccatgtgatgttagagtgagaaagctgctgtcaatgaggaagcaggccctcaccagacaccaaaactgtctgtttctcgatcttgtactttttatcctctagaactgtgaaaaataaatttctgctccttataagccatccagtctatgatactgtgttatagcagtcaaacagactaagacagggcctaacattctattcctaccttcctaaaatgtttaagaacagacagacatcttgatagcttttaacaaatcagcttgttctagttttaggaaaacaaacaaaactcaacaagactctctgttctacacactgtctgtggttttcttctttctataaacaccatctttgcatttgttaccagagacaatctttctttctttcccctccctccttccctccctccttctttccttcctccccttaccattccttccttccttccttcctccctcccttcccatacagacattccattctttctgttagtagaagtaacattgggaaacttaatgtgtgtcttttgaccatcaggtcactgtcattaaagtatacagtgacagggaatctggtctctattgagacaacttgctgttgtctgtattttcttttgattggcacctattatagaagcaaggaagtggggtttgatgggaagaatgtcagactgcagtgaaattctcagaaagctttagtcatgctgttgactaaagtcaccagttactagaatagtgcatctagtagtaatggaccagcactaatagccttgctgtgctcagacaagctagaagtagcctgtgggacatatggcttctataaatgctgcagtagatccaaagggggcacttacatggtattgtaagtcagctatgttctctgcaccaggtgatttgggtggtgctctttcatgaccaccatgcccccattgcagcagtagccacactaatttatgccttggcatatattgtcctaactttatcttttctgtgggtccctaatgcaatagaagccttaaaacttcaaaacaactcccaaaaattctcaatccactaggttactgcctgtggaattctgttattgttgacttccaaaataagtaataaaaataaagagttatgctatttttttctaatgaaaagtaacatcttgactgcttaacagatgttcaaaatctaagtattaatatttcccatcctgacttgactgatacgtccctagacaatgctgatatggtactatttgttcatgtggttaagaatggactttctgagtcatagaaaagattcatatttcactctcacttgtaatattaaatcgttttatgaagtagtggaaccaatttacactcttatcagcaatgtatgaaaattccatttaatccacatccttaacgacacaaaaaatattatggagggtgtgtggtgatatttctttcttttttttcttaaaaattttttattggtaaacaataattgtacatatttgtgggttacatgtaatattttgatacatgcatataatgtgtaatgttcattaacctcttaagaatttcatttccctgatgactaatgaagttaaatatttttcatgtatttttggccatttgaataccttatttttgagaattcacttgcaactcttttggaagtttttagcgtttttttttttttcttactgatctgtatgagttctttttatatctttgttaggattctttgttggatatatgaattgggaataactttcatctgtgtaggttgccttttcatagtttttatcatttcttttgacgaacagaatttcttaatattaatattgttcaatttatcattgttaaatgtgtggtttataatttcggggtcctgtcaattaactgtcttactctctcaaactgtattagtttactttaatacttaggtcagaaattcctatggaattaatttttgtgttacagtgggaggtagggctcaagatacatatttttctctatgggtattaacttgacctattaccaattttatttaaaaaactatccatttattcacaccattttgcaatggagtttttgtcacatattatgtgatgtgtgtggatttgtttatgaactctatattttttatttttctattgatcagtttgtaactttttgggccaatgtcccttgtttatcaatttataataggtttattatgggtctagatatctaatatgtatgccattcagctttttaaaatcttctttgatctcacaatagttattccagggcttttcaaagccagttgtattttcacataaaatttagaatcagtttgtcaatttctaaaaaaatttcccaaacttgttagaatttttattgcctttatgttgaatgaatagattaattgacactgggaaattatatctttataatattgtcttctaacacagaaacatgtgtcttgttccattaatttatgccttttttatttctcccagtaatgtttcataatttcaaaatggaaatcttacacatcttttgtttgctatattcccagtcaacatttttgtgcaattttaaatgacatcatgttttaaatttatttttgcttaatgctagtatgtatgtatttacatatatacatgtaaacatacacaaatacatacaaaatgtatataacgtattttgtattttgatctcgtgagcagtaacaatgcttaaactatttgtagtctaatactttgtagattcttttaattttctaagtatataatcctataatttccaagtaatgaaagctttatttttttcctagtatttaatctcctttctttgttgcttcccttcctttcctctctcattccccttcctcttctgtctcctttttcttctcctctctcctctccttccaacatttcttcctctggcttgaacgtcgagtacattagtgatagaggcattcccagtatcatgagaaaagtatagtggtttctgtaaaatttttttgcatatagtctttgtttatttttgtagtttaccgagaatttttttatccaaatgaatcttgaatgttgtctttttctgcatttacagagatgatcatattatttattttctgctaatcttgtgatgaaatttattgagttttgaattatacatttttgctataatccctactaaactgtgatatattatcctatttattagtcatggatccatttttctaatatttagtaaaatattagagttgagttgactaaaggaatgtctaaacagtcctaatgtgggtaaaggtccagatctgggctaaataaagtcaaagcatgaaaggaaggcagtagcagcgatcacactgacaagagcacatcacttacattctacaggtaacatttcaagtatatatatagttttaacccacaaataactacaagtgacttttctgacagcttagcttcttcaagggagaactgttcttctcaataactttcagtaaatcagcttaaccaaggaaaagaaaactaaaattatcggcgaatttagcttttataaactctgtttttgtttgaagaaatcatctttacatcacttgtctccttcagatatgagtaaactttggctgtaactagcttagtgtcttaaaattattctttgacattttatcgtttactcattttgacatttagttgttatttgattattaacttttactatcacttcatagaatacaaactgagagaacagggaacaaaactattttgctaactgctctatgcccaatgtcccgaagaatttataatacctgatacatgctcaataaatatttgtcaaatgaataaatgaggatataagttaacaataatatgacattagagaagtttcttacatttttgtgacatgagcaatcagagaactgaatttgatatttgtacgtgcttttccagttgtaaatacacacacagacacaaagacatacacacacacacacatacattttatgacctacaagcatgaaatttcagctttgcgaagattaatagatgcaaacttttcaacactcatatgagtatcttctgtgcttaaggaatttaacttgaaaacatgtgtttaaaaacgatctttatagaatactttgtgcaaataatatttaattacaaacacattgctaataactgcctgctgtaattcctggcatataggaggccctaatgtgagtaattaaattcttgttggtaaaaagtaaccattacatcccttacccaccatgagccatatcccttttctctagagaataatcatgaagtcaaatgtacaaattgtgaaagtaacaactgctaagagtttgcttttacaattattattatatatattgtaatggggagacatgtagcaaccataaggtattaggcatttgaacacaaatcagtaagatcaatatttatgcatccatgtaacagattgaaccgagaattgttgaaaataaccatttcaggaaagaaaatatactattagttgataactttaaaaacctcaatgcgtgcagttaaaaggttgaaatcgctgtgtatttgtgtagcatacaactgtcagacttgaaagattttctagcattttattgatggatatacacaataatgaagaatatagacatggctttagtaaagagaatgaaatacaccttcaccttctaggttggctgagtggaaattatattcatacttacagtttaatgctaatgagaattcgaagacaaagtcagagaaataggctagcattatctgttgtatcttttttatgtactatgaaaaagtggtcctggtaccacataaacttacaacaacaatttaattaaactccaaaatacatttcccaatcttttgcagcttagagatttagacctcatgcagaagacaatatattaatgtaagtctaaattttagtcccatgtggaaaaattaatagtcaactgattttttccaaaatgttttagctgttagctatgggaaaaatgcacataacgataaagctaaatatatctcacatttcatccttcatataatttttgtttatgaagattctatggaggtatttatctcaattttaaaataaatatcttcacaatcaacatctataataacaaactctacataaatgatagtttaacccttctgtgatcttcattttttttcttaataaggggccaaacatatctttctccttgtagaaatctttatctggcctatgctggccacaaaatatcttcttttgctctttggatcatgcttactgagaaaattttgaaattatggaataaaaataatatatttatttatataatgtgtgaagataaaatttggggaatgactgagtttatcaaataactgtgtaagaaatagtaaatgatatactctgatacaatagaagtatccatttatgtttccctccctgtggaaattcatgaagcctatagtgaccgtctgactaacagaatcctgctactttatgaagctccttgctaaagccagggaattgagcccagtcaatggcactgatatattctaagggttattcccacataatgaggactctcacactacttttatattaagcagccattcaacaatttttattgacgactaatcctatctcttttttaggctaggcatacttttgggtatagggtggaataaggtaccactcctatacttaaggatacaacatacatgaacaaatagtaactttagcggatactatagtcgtaagctgaatctctggatctcagaattcagagtcctccagaaatggtctccatataagaaattgacaaacaaatgaatcctttgcttggaattaggcttctagcttaaataactggatgcatggtgctcttgattactgaaatgagaaagtaagatgacaaagcttgaaaaaaattgtgctaagcaaatttttggacatgtagtacttgcagtgtatttgagacttccatgaaatgtcaaggagacaactaaacacgtgtttgaaacacagaggagagatttgtgttgaagatcacagtttggctgcatataattgaagtcatatgggcttaactgaaattgccgaaggagcgttagaggaaaaagaaaacagagcctttggtgaccattgaagaattccaccactgaagaatatgatagagaaagaagatgtaagggacattaaaagccactgtagaggtagaaagaaaactaagagtgtatggtgacaaaaaaattaagaggagagagtggtcaaaagtctacaatgctgctgagagttcaaattatataaataataaactatatccattgggtataaaatggtagcctcagctaaagttgttgcagtggattgataggagtagaagcagaacttgagggactgaaaagcaagtacatgataatgagcagtatttacatgggaggaaagttctttgtacatttgagagacatgagtcatcaatagtgtatgtttcctaacaaaagacaaaagaggatggaataaacaaagaaatggagaaattgcctttaggacaagaaacttctttctatagtaaatagataaagagaaattggattcatgtagagcaatagttctcaatcttgcctgaaatactatggtatattttccctctgaaataattgtaggatgcaggttaaaaaatgacaaaactacagaagttagactggaacatagaagaggggatgattaatgatatcggaggagctagatgaggtaaaatgtgatgatcatgtgaatgagttttgataatattaaataaataggaaaaattcatttggggaaatatttctgctctagctagaagattgcaagtctttaagtaggtgcttaagtgtaaactccttggcatagaatgcaagaccattgataaaatgctccctcgaacggtttcctatttgccttcacttctagactccttctgtgttgcagttgtatagacttcttaagcagtcccttccatataccatgcttctcatggtttattttattttaaaatcatctttgatcccccactcttatgcaatgaaggttagtagctctcacttccaagcaccctatcattcttaccttatttttaattttttaaattttaatgtcttataaggtttatttataactactttttgctccactcctgttagtaaatggtctcctaatttacctattttctggcaactatccctcatgcatcacataaaagagccactcaataaagttgtttcttaaccaagtgaataaatagatgaattatgaataaatggatgtagaaagcacaatctcaaataatttaaggcaggacagagtatttcatcttaatttaatatcttccattgacaaatggagaggtcaagcagaacagatgaaatgataccctttagctcaggcagttaatttatggtaagactaggacacaaactaagttctcctgatttttagtgatgtttagtttagttctcatactagcacatcataaaacttgttatgccgcctcctcccctgtagtcagcaacctatttaaggccttctcgccgggcacagtggctcatgcctgtaatcctagaacttcgggagactgaggcgggtggatcacctgaggttgggagtttgagaccagctggccaacatggtgaaatcccatctctactgaaaatacagaaattagccaggagtggtagcgggcgcctgtaatcccagctactcgagaggctgagaatcgcttgaacctgggaggcagaggtggcagtgagccgagtttgagccactgcactccagcctgagcgacagagggaaactccatctcaaaaataaaaataaaaataaaggccttcttttatgctgtcaggttcttggatatttccagaagagtagcatgtccctaaggacactttggatctctgggaccattccaagacaagcaaagaacggtaagggcattggtaaacataaagcaacttctctgaatttacctatttttatacttatggcctcagttttcagaaaacacctctctattcattatactactaatctttatggagattaagtggtacaataatccccttaaaaatttctcattggtatactttgcagcatgctactcatgaaaagtagtgagtttattttgttgctacaattagatttttgtaaaagaacaaatcttaaaattagtttcaaatccactaggtttgaaacattattcacgtggtttattctgccaacacaagtaaattaattctctaaatattaacaaacaaaaaactgactttagacattggctgagagataatttacagcatccatttacaaatatttattggttattggattagtaagggtcccttggttgaaatccacaggatacaactctagtcatttaagcaaaattagttttattataagcttcatgatttctcatagataaaagataaactaaagaaaaaatgttcctgaaaggttaataatcatgaggactccaggaggagaaaaaaaaaaaaaaaggctcctaagtgaattgtcactggaattaaatcatctccatttcccatcctggagtaactttgctcaatattcatatttctgaaaggaagcaacttattggcctagctcgggccacatgctcataggaggataagatttatttgactgatatccccaataatcatgcttgaaagaagatactggtcattccacagaggaaaacttgcagtgctattatcccaccaaaggatatggatgttggccaggcacaaacagactgatgataattacattaatgatatagtatttttttaagctggctgagatgagatatgcctacttatttatttatttaaaattgacaaaattatatatatttaatcatgtacaacatatgtatgctttgtggaatggctaaattgagctataacagataaattacttcacatacctattttttgtgtgtgtgacacttaaaaatctttcttagcaattttcaagaatacaatacattgttattaattatactcactatgttgtacaccagactcctgtattattcctcctatgtagctgaaattttgtatcctttgaccaacatcttctcaacctccttcccctcagcctctggtatccaccattttacattttactctttacttctataagctcactttttaaaaatttcgcatgtaagcgagatcacacagtatttgtctttctgagcctggctatttcacttagcataacgtcttccaggcttaaccatgctgttgcaaatgacaggattttcttctttttaaaaggttttatagtattccattgcttccatatgccatgttttctttatccattcattaagtaatgtatatttaggttgattccatatcttggctattacgaataatgctgtaatgaacatacaactgcagatatctctttgacgtagtgcttttattttatctggatatacatccagaagtggaattactggttcataaaggaactttatcattaattttctgaggaacctccatactgttttctaaaatggctgcactaatttacattctcactaacagcacaagtgttgtcttttctccacatcatctccaacatttgtcttttgtctttttgatagtagtcattctatcaggtgtgaagttttagttctttgtggttttaatttgcatttctttgataattcgtgatttggagcatttttaatatacttgttggctgtttgtatgtcttcttttgagatatacctattcatgttttgggcgcattttaaatttcttttcttactattgagttgtttgagttccttatattttgaatgtcctttatcagatatacagtttgcaaatattttctctcattttgtaggttgtctctttgtttctttggctatgcagaagctatttcatatgatgcaatcccattcatctatttttgcttttattgcctgcattttagggatcatacccaaaaaagaattgcttaggccaatgtcgtggaagttttcccctattttttcttctagtttttacagtttcaggttttacatttaagtgtttaatttattttgagatcatttttatatatggtggagataaggatataatttaattcctctgtatgtagatatccagttgcctcaacacactattgaagagactgttctttccccactgtgtgttcttgacaacttcatcaaaaatcaattgactgtagctgtgtggatttatttctgggttctctattctgtttcattgtaccatctgtctgtttttatgatagtaccatgctattttgattactataacttgtggtatattttgaagtcaggtagtgtgatacctctagctttgttctttttgctctttagggaacaatgggtgttttgtaacaaactttcagtgaaacagagaacctctctgtcctgataatggaccccattaatttggtttcttaaggaaaaagatggctttactattgagttcacccattcactcacccatattactttgggcagtcaactaacatctaataattacttattctcttactacagatatttgctacaccctggattcacaagaaattcttatgttgtatgtcaaagaaagcaaatgtccaataaagataatagcaaagtgaataaatttcaaattccctaaagataatgcaacataatccacaattcagacaaatgaaagagtaacatcatgggcaagtggtaggaaatattcattgctgtaaataaaaaattttgggcaatcaagttgctgataaacccagtttttcaataaaatccataataattattatttagaaaagaattgagtaggtttaattgagaggaccttggaattagcctactacagtctgaggctcatgtctaccaaattttatcattttaacctcggtcaagtgacacggtttctccatgtttttatttacgaaataatacaatttcctttataaagattattgaggcctgaaaaaagacagcatgtgtataatatttttagaagaaacccatcatataagtgttcaataagtgacagttgttagctatactttaatcatctgacttaaatttataaaagtcaatactgcttctgatcctagagcactgttaactaaatatggatactctactgcagagatggatcattgtctaaatacattttcagctatcataatagagtgcccaataatgatttatagatgaatatctgtatctatatgtatatctatctgtaatgattatatataatgaatatgtatgcaatttcattattaaaagtataatatcaatattattttgatgtttccataagtgttttctttaccattttaaaggtaaacttttggcctagtaaggagaaaatgagatatgaaaggtcatcacattagacaccacttagaagctatgtttattgctatcagaaagtctatattctgaagttttaaagtgaaatttcgaacagaaactcttctttcattatacttcgcaaacataaatctatatatttataaggctttcttcttctacccaagactttgccatttaccacattctaactactctctgaaaaatccatttctctctttttccacattaggcattttttacctatctttttttttccttttactttggttgagccataaaaattgtacatatacagagtgatatgtgtatacaatgtgtattgatcaaaccagggtaattagcatattcatcaccttaaatagttatctttttttttaacttttattttaggttcgggggtacatgtgcaggtttgttatgtaggcaaattgaatgtcataggggcttggtgtacagattatttcatcaccaaggtaataagcatagtacctcataggtagttttttgatcctcacccttttcccatccttcacccataagtaggccctggtatctgttgtttccttctttgtgtccatgtgtcctcagcgcttagcttccacttagacattagaatatacggtatttggcttttgttcttgcattaatttgcttaggataatggcctccacttccatccatgctgctacaaaagacatgatttcattctttttttatggctgtgtgatattttatggtgtatttatgtcacattttctttatccagtctattgttgatgtgcacttagctttattccaggtctttgctattgtgaataggattgtgataaacatatgcatgcatgtgtctttagggtagaatgatttatattcctttgagtatatacccaataatgggattgttgagttcgaatggtaattctgttttaagttccttgagaaattgccaaactgctttccacaatggctgaacgactatacattcccaccagcagtgtataagcattcccttttctctgcaacctcaccagcatctgttaatttttgactttttaataatagccattctgattggttgtgagatggcatgtcattgtggttttgatttgcaattctcacatgatcagcgatgttaagccttccttaatatgatcattggctgcgtgtacgtctttttttatctatctagaatttttttttaatttttctttaattttatttatttatttattctttaaattctgggatacttgtgcagaacatgcagattttttacataggtatacgtgtgccatggtggtttgctgcaccaatcaacatgtcacctaggctttaagccccacatgcattagctatttgtctggatgctccccctccccttatcccccacccctcgacaggccccagtgtggattgttcccctccctttacccacgtgttctcattcttcaactcccacttataagtgaaaacatgcagtgtttggttttctgttcctatgttagtttgctaaggattgtgtcttccagcttcatccatgtccctgcaaaggacatgatctcattcttttttatggctgcatagtattccatggtgtgaatgaaccacattttctttatccagtctatcactaatgagcatttgagttggttgcatgtctttgttattgtgaatagtgctgcagtaaacatacatgttcatgtgtctttatagtagaataatttttattcctttgggtgtatacccagtaatgggattgctgggtcaaatgatatttctggttctagatccttgaggaatcaccacattgtcttccacaacggttgaaccaatttacatccccaccaacagtgtaaaagagttcctatttctctacagcctcgccagcatctcttgtttcttgactttttaataatcaccattatgactggtgcgggctgatatctcattgtggttttgatttgcatttctctagcgatcagtgatgttgagctttttttcatatgtttgttggctgccattaattactgcctcaatttcagaacttgttattggtctatccagggattcgactttttcctagtttagtcttgggagagtgtatgtttccaggaatttattaatttcttctggattttctagtttatttgcatagagatgtttatggtattctgtgatggtagtttgcatttctgtggggtcagtggtgatatcttctttgccattttttattgcgtctatttagttatcattttttgtgttgtaaacattcaaaattcttttttctagcttttggagagtatacaataaattacagctaatcctatttacccaacagtgctgcggatcaccagaactcattccttctatcgagttgcaattttgtgtttgttaaccaacctcttcctagcccctcatcctccctattttccgtgtttctaatacccacaattatactttctacttctgtgagctcaatatttctttttatcttccacatatctgtgagaacatgcaatatttaccctctgtgcctgacccattttgcttaacatagtgtcctccaggctcaggctcatccatgttgttgtgaatgacagattttttttttcatggttgaatagtattctgttgtgtatacataccatggtttctttatctattatctattgatgaatacttagattgattccatatcctagctattgtgaatagtgctgcaataaacatggggatgccgatatttctttgatatactaattgtctttcctttggataaaaggccagtagtgggattgctggctcatatatagttttacttttagctttctgagaaactttcatactcttttccatagtggctgtactaatttatattcccatcaacaatgtataaaaattcccttttttctatatcctttccagcatttgctatttgtaatgtttcttaaaattcataaggaactacaaaagacccttcatagtcaaagcaatattgagtaaaaagaacaaagctggagacatcacactactttttgtcttcaaaatatataacaaaaaattataaaattggtataaaagcaggcaactagaccaatggaacattattttaaaaacccagaaataaatccatgtatttacagccatttgatctttgacaaagaacatacattggggaaaggacactttcttcaataaatggtgctaggaaaattggatatctgtatgcagaaaaatgaaactagactcctatctagcaccatgttcataaatcaactcaaaacatataagcaatttaaatgtaagtccccaaactataaaactacctgaagaaaacataagggaaaagctttaggacattggtctaggctacaattttatgactgagacttccaaagcacaagcaacaaaaacaaaagtagatgaatgagattatattaaactaaaaggcctctgcagaacaaataaaataatcaacagagtgaacagacaacctgtagaattggagaaaattttcacaaactattcagaattgaatgtcttgtaatgttgagaatatacaaggaactcaaacaacccaacagcaataataataatgatcatcatcctcatcatgatcatcatccctttaaaatgttgccaaggacttcatcagacatttctcaaaagaagacacacatatagccaacaacatgaaaaattaatgcttaaaattattaaccattagggaaatgcaaatcaaaaccacaatgagatattaatatcaacttaccctagttacttattttttatagaatgtatcacattattttttgaaagtatttacagatccttctcttttgctggactaaattcagaggctggtatcatgtattcactttcttattgtggcttctcacacagagccgggcacatggtagaaattcaatcaaggtttgttaaataagtaaatgaaacatttggcaaaataagcgtcatttcaagacaaagttcctaccctgttttcaacaagaggctgggtgaaggcagtgtttattttttattgctccattacttccttggtccttaaattatattcttacttttggaaaaaaaattatctttcaaagcaatgtatctcattcttcgttaaaggaatttgctcaggttctgtgaacatttcattgccctatataaatgttttagtgactaggaaacaaaaatatccaggcctatgaaaagtgtaatgagtcccaatatagccatttgtaatggggatttaactgctttgtttgtgagcttctgctaaggaaacagattaccttcatcatgtgctaataccccggagtcgatgtaaactctgttccactgtagaaaggtatcatggggatgccagcaaagactctaagatcaattttgtaaacctgtaagctggtaaacaaaaaaaaattattcctggttccaaacccagctcaacactcttcttccttgtaaaggacttaaaactaattaataaattgtcatagatattttcaaaattgaaatcctattttcataataattgaagcacttgtgtacaaaatattgtgtactgaatgtctaagaacctaaggtctaagagagtcataatgaaaaagacataattccttggattaaattatgatagtgtcacaaatgtcaaaaaattatttaattagcctgaacttgtcacaaaagctttaagtgtatctttgtttcccatacagttttactttgcttaatttcaaatttgtcactgttatatacatatatatatatatcttatctttacattataagccttaataaatgtgaggtctctgtttacatgcttggtaaatacacttttaccttctcacctaccacaacaaatagcactaaaccattacggagagagtagtcagatttataaaaattaaagcaaatgcacattattaccatgtgtaaaaatactagacattacatacattgtatataaaaatactatgatataatgaaaatatatcatatgtaaaaatgtcaactgtgtaaaaaacatttaaaaaaattctttcatgcttattcaacaaatgtttcctaaaagattttccttgaagcaaagcaatttaattttttctgtcatagtattctcagtggttataaacttaattatctttgtatgcttcacatttacttgcatttatgacaaattttttattttcttagcataactttttgaaatcaaaatatgaactagcaaggtgtaagtttgattagaggaacaagaacaataacaagtaatcatagcaatgagatgttaattggtgtctgggtagttttattcatagtaacaaggggacataatatctctgtgtcctttactgctcaacaacactttgctagatcttcttttataatgccaattatattgcacttgaaattcacaggtattttaacagcatagagggatacagactgattaaaaagactgtctcttctaacagggaggcaatgtttaaaattaaggcgatatatttttccaaactcccttgtcttaaatttcaaagtccaaagttgaagagttttgagaattatagtttctaaaaaatcctggttaaggtatatttgcattataagattgaccaattttctgaaaagatttttcctgcagtaaatgagagcaagaaacacgaaaatcaagtgtagtaaaatgtaaaaagtttttcttaggaattatcttaagtaattttagcatggagcagtattttagatgcagacgctgaaagggaatcttgatttgttgttttgtgtgttcatatagctagtagacactgctagattgattgattcaaaaataaaacagaattggccattttctagtgaattgtatttctctataggaaatttagacaatttcaggaggttgggaagtaaaaacatttacactaagcattattaaatttacttacctgcataatctcaattctcagataatggtcagttattatacatttaaaaaatgattttataaactctcccataaattgtcgaaaatacagagaaaactcattagaaataaataagcttagctaagaaattattcagtaattggagctgtttattttgtcatccacacaggaaccccatccgtaggtcaccaacatcaaagaccaaaaatagataaatccatgaagacgaggaaaaaccagcacagaaagactgaaaattccccaaaccagaacgcctcttctactccaaaggatcgcaactcctcaccagtaagtaaacaaaactggacggagaatgagtttgaagaattgacagaagtaggcttcagaagatgggtaataacaaactcctctgagctaaaggagcatgttctaacccaatgcaaggaagctaagaaccttgaaaaaaggttagacaaattgctaactataatgaccagtttagagcagaacataaatgacctgatggagctgaaaaacacagcacaagaacttcatgaagcatacactggtatcaatagctgaatcgatcaagcagaagaaaggatatcagagtttgaagatcaacttaatcaaataaagtgtgaagacaagattagagaaacaagaatgaaaaggaatgaacaaagcctccaagaaatatgggactatgtgaaaagaccaaacctacgtttgactggtgtacctgaaagtgatggggaaaatggaactaagttggaaaacattcttcaggatattttccaagagaacttccccaacctagcaggacaggccaatattcaaattcaggaaatacagagaatgccacaaagatactcctctagaagagcaaccccaagacacatacataatcctcagatttagcaaagtggaaaagaaggaaaaaatgttaagggcagcccaagagaaaggtcaggttaccaacaaagggaagcccatcagactaacagcagatctctctgcagaaacccaacaagccagaagagagtgggggccaatattcaacattcttaaagaaaaggattttcagcccagaatttcacatccagccaagctaagcttcacaaatgaaggagatataaaatcctttacagacaagcaaatgcagagagattttgtcaccaccaggcctgccttacaggagctcctgaaggaagcactaaatatggaaaggaaaaaacggtacctgccacttcaaaaacacaccaaattgtaaagaccattgatacaatgaagcaactgcatgaactagcgggcaaaaaaccagctagcattataatgacaggatcaaattcacaggtaacaatattaaccttaaatgtaaatgggctaaatgccccaattaaaagacacagactggcaaattggatagagtcaagactcatcgctgtgctatattcaggagacctatctcatgtgcaaagatacacataggctcgaaataatgggatagaggaagatttaccaagcaaatggaaagcaaaaaaaaaaaaaaaaatgcagaggttgcaatcctagtctgataaaacatactttaaaccaacaaagatcaaaaaagacacagaagggcattgcataatggtaaagggatcaatgcaataagaagagctaactatcttaaatatatatgcacccaatacaggagcacacagattcataaagcaagttcttagagacctacaaaaagacttagactcccacacaataatagtgggagactttaataccctgctgtcaatgttagacagatcaacaagacagaaaattaacaaggatattcaggaattgaactcggttctggaccaagtagacctaatagacatctacagaactctgtaccccaaatcaacagaatatacattcttctcagcaccacatcacacttattccaaaattgaccacatagttggaagtaaaacactcctcagcaaatgcaaaagaatggaaatcataacagtctttcagaccacagtgcaaacaaattagaactcagtattaagaaattcactcaaaaccgcacagttacatggaaactaaacaagccctcctgaatgactactgggtaaataacgaaattaagtcagaaataatgaagttctttcaaaccaatgagaacaaagatacaatgtacctggatctccgggacacagctaaagcagtgtttagagggagatttctagcactaaatgcccacaggagaaagcaggaaagatataaaatcaacaccctaacattacaattaaaagaactagagaagcaagagcaaacacattcaaaagctagcagaagacaagaaataactaagatcagagtagaaatgaaggagatggagacatggaaaacccttcaaaaattaatgaatccagtagctttttttttttaaagattaacaatacagatagacctctcaccagactaattaagaaaaaaataaagaagaatcaaatagacacaataaaaaatgataaaggggatatcaccactgatcctacagaaatatgaactcccatcagagaatactataaacacggctatgcaaataaactagaaaatctagaagaaatggataaattcctggacacatacaccctcccaagactaaaccaggaagaagttgaatccctgaatagaccaataacaaattctgaaattgaggcattaattaatagcctaccaaccaagaaagcccaggaccagacggattcacagctgaattctatcagaggtacaaagaggagctggtatcattccttctgaaaatactccaaacgatagaaaaagagggactcctctctaactcattttatgaggccagcatcatcctgataccaaaacctggcagagacacaacaataaaagaaaatttcaggccaatatccctgaagaacatcaatgcgataatcctcaataaaatactggcaaacgaaatccagcagcacatcaaaaagcttatccaccacgatcaagtcagcttcatccctgagatgcagggctggttcaacataaacaaatcaataaatgtaatccattacataaacagaaccaatgacaaaaaccacatgattatctcaatagatgcagaaaaggcctttgataaatttcaacaccccttcatgctaaaacctctcaataaactaggtattgatggaacgtatttcaaaataataagagctatttaagacaaacccacagccaatatcatactgaatgggcaaaagctggaagcattccttttgaaaactggcataagacaagaatgccctctctcatgactcctatttagcatagtgttggaagttctggccagggcaatcaggcaagagaaggaaggaaagaaaggtattcaaatagaaagagaggaagtcaaattgtctctgcttgcagatgacatgattatatatttagaaaaccccatcgtctcagcccaaaatctccttaagctaataagcaacttcagcaaagtctcaggatacaaaatcaatgtgcaaaaatcacaagcattcctatacaccaataatagacagagagccaaatcatgagtgaactcccattcacaattgctacaaggagaataaaatacttaggaatacaacttacaagagatgtgaaggacttcttcaagaactacaaaccactgttcaaggaaataagagaggacacaaacaaatgaaaaaacttcccatgctcatggataggaagaatcaatattgtgaaaatggctataatgcccaaagtaacttatagattcaatgctatctccataaagctaccattgactttcttcacagaattagaaacaaactacttaaaatttcatatggaaccaaaaaaaaaagcttgtatagccaccacaatcctaagaaaaaaaaagaacaaagctggaggcatcacgctgtctgacttcaaactatactacaaggctacagtaacaaaaacagcatgctactggtaccaaaacagttgtatagaccaatggaacagaaatgaggcctcagaattttgccacttatctacaaccctctgatctttgacaaaactgataaaatcaagcaatggagaaaggactctctttttaatatatggtgttgggaaaactgactctccatatgcagaaaactaaaactggaccccttccttacacttatacagaaattaacttaagatggattaaagacttaaacataagacctaaaactgtaaaaactctagaagaaatcctagccaataccattcaggacataggcatgggcaaagacttcctgcttaaaataccaaaagcaattgcaacaaaagcaaaaattgacaaatgggatctgattattctaaagagcttctgcacagcaaaagaaactatcatcagagtgagagaaaatttttgtaatttatccacctgacaaggctaatatccagaatctacaaagaactcaaacaaatttacaaggaaaaaaaaacaacctcatcaaaatgggcaaaggatctgaacagacacttctgaaaagaatgcatttatgcagccaacaaacatgaaaaaaagctaatcatcactggtcattagagaaatgcaaattgaaaccacattgagatactacctcacaccagttagaatggtgatcattaaaaagtcaagaaacaatagatgctggagaggatgtggagaaataggaacgcttttacacttggtgggagtgtaaattagttcaatgattgtggaagacagtgtggcaattcctcaaggatctagaaccagaaataccatttaacccagcaatcccattactgggtatatacccaaaggattataaattattctactataaagacacatgcacacgtatgtttattgcagcactgttcacaatagcaaagacttggaaccaacccaaatgcccatcaatgatagactggataaagaaaatgtggcatgtatacaccatgaaacactatgcagccataaaaaaggatgagttcatgtcctttgcagggacacagatgaagctggaagccatcatcctcagcaaactaacacaggaacaggaaatcaaacaccacatgttctcactcataagtgggagttgaacaatgagaaaacatggacacatggaggggaacgtcacacactggggcctgtcagggggtgggggggctaggggaggcatagcattaggagaaatacctaatgtatatgacaggttgatgggtgaagcaaaccactgtcgcacatgtatacctatgtaacaaacctgcatgttctgcacatgtatcccagaacttaaagtataattaaaaaaagatttaataatatgaaacaggtaccgtctattctggattgcattgaccaattggagaagatgccagccatctgtaactgctaaaaatatatggatacatccgatctgaatcacttgcttattaaatattatattttaggataactaactccaaacacaatatagaataaacgtatcatttgctaaaaatataatttaaatatgatatgtgtattgcatgaacaaatatagtgctgtggttcccaagtaagatgaggaagaagactttgtctttctcctgcccactctcgttcccttccaggggctctaagtcaacattgactgcatatttagttttaaaaaagcatattcaaattatcgggctatgtttgctagcatgcagtttacattgagatcatttactaattggcaggacaataagcttgattataaagtcacttaaggtaaggctgcattctatttttttttggagtttatagaatttatatgcttctgtcaagcaaatcagccagtttcactctccacaatcaaaattaaagataaatgtgtatcttgttattattgaaaattatctttggtactaatttgtgagaagtccagataacattgattaagggaatgagattttgatttttatctaagggaaacctgaatttaaagtttcgataagttctgatgctaactaatattcttccttcactaaagagaggaataatgcctaaactgaaagtttacaagggaaattctaaattccattctgtcctctgtcttattggatatccatccaggttctctctgagtcaaccttgtgctctaccttcacggaagcatttagttttcacacaggacaggaaaacaaatgagtctgtgtttttaaaggtgtagcaatagaaataaatctgtcctcgggcaaatatcccttatccttttctgtgacgtgctcttctgtgggtttgcctgtacttgccttttatagccacagcgtgattatattagtgtgtgaatgccttagcaaagagccaacggtagcagcagcctgcattaggcccaagatctacaacgaaaccagcaagggccaattgagagttctgggctatagtaatcctgattgttttttttctttttttctttttttcttttttaattattattattattatacttaaagttttagggtacatgtgcacattgtgcaggttagttacatatgtatacatgtgccatgctggtgcgctgcacccactaacgtgtcatctagcattaggtatatctcccaatgctgtccctcccccctcccccgaccccaccacagtctccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttaaagtcatttgggtatatacccagtaatgggatggctgggtcaaatggtatttctagttctagatccctgaggaatcgccacacttacttccacaatggttgaactagtttacagtcccaccaacagtgtaaaagtgttcctatttctccacatcctctccagcacctgttgcttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgacggggatggcattgaatctgtaaattaccttgggcggtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattccctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttaatgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgaagctggcctcataaaatgagttagggaggattccctctttttctatggattggaatagtttcagaaggaatggtaccagttcctccttgtacctctggtagaattcggctgtgaatccatctggtcctggactctttttggttggtaagcaattgattattgccacaatttcagagcctgttattggtctattcagagattcaacttcttcctggtttagtcttgggagggtgtatgtgtcgaggaatttatccatttcttctagattttctagtttatttgcatagaggtgtttgtagtattctttgatggtagtttatctttctgtgggatcggtggtgatatcccgtttatcattttttattgcgtctatttgattcttcgctcttttcttctttattagtcttggtagtggtctatccattttgttgatcctttcaaaaaaaccagctcctggattcattaatttttcgaagggtttttcgtgtctctatttccttcagctctgctctgattttagttatttcttgccttctgttagcttttgaacgtgtttgctcttgcttttctagttcttttaattgtgatgttagggtgtcaatttggatctttcctgctttctcttgtgggcatttagtgctataaatttccctctacacactactttgaatgtgtcccagagattctggtatgttgtgtctttgttctcgttggtttcaaagaacatctttatttctaccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaagtatgtggtcagttttggaataggtgtggtgtggtgctgaaaaaaatgtatattctgttgatttggggtggagagttgtgtagatgtctattaggtccacttggtgcagagctgagttcaattcctggatatcctttttaactttctatctcgttgatctgtctaatattgacagtggggtgttaaaggattgaatcacctctcaccaggcccaacctccaacattgaggtttacaattgaaaatgagatgtgaatgtcgacacagatccaacccatatcacacttcaatttaaaaacaaagatgccagcacaattacaaatgcacaactaaatgttgattatacagagcattttcaattttaggatgctacattggtttaagtgaaaagatggaaaatacgtgtgtgtgtgtgtgtgtttgtgtgtgtgtgtgtttgagtgtgtgtgtattttccatactttctacatatatatacataccactcaaacattacccaaaagataactggtgtggttatataaatatcgaacaaagtagatttttaaggcaagaagcatcatgagagacagagatattttataatgacaagagagttgatttcaactggatgataaacaatcctagagttgagtcaacctgaatacctttgaaatatatggaaaaagttgactaaaatctctgaggatatgggtaaagtcacaatcatagttgaagatttttttaagttttatagagtaaccaaaatacaattgatgttgcaaagaacttatatttaaattatacaatttgataaattttaaaacatgtatacagccattaaactataagcacaaagaagacaataaacatatccagcagttaactaccccaggtttagtcatgtcccagcttaatccctcttcctcacttctccttgccttccttatctccagacaaccactaattaatctacttttggttattaaagattagtttgcattctctagaaaagactgttacatgaatgaaattatatagtttgtactcattcattgttggaatttcatttagcataattattttgaatttttttcatattgtatttatcagtaatctatttttattgttgagcagaagtttattgatttggcatatcaaattatttatatccatttattgttgataggcatttggattgtttctactttatggctattaatacataagattgctatgaacatacgtgtacaaatctttgagtgcactcaagctttcatttatcttgaaatatctaggagtgaaatgattggatcatatgcttggtgtacaattaactttttaagaaactgccaaacttatctctaaagtgattgtatcattttacattcctaccagcagtgcatgggaagttctggtgttaaatatttgcacaaatgctatattttaattccaatggctatgtaaaggtatctgattgtagttcaaatttagatttccttaaggattaatgatgttgggtaccttttcatatgcttattctccctcagtatatcatctctggtgaggtgtctattcatgtcttttgcccatggtatcggtttcactgacttcatataataacttggaaagtattctatcttattcaaattcctggaagattatctctaatattgttattatttttccttaaatgcttggtagaatttaccagtgaagccatctaggcatagagtttcttttgtgagaatattttttttaacaacaaggccataattaatatatatagacaattgtcattatctatttctttttgattaaacattggtgctttgtgtctttctgagaatgtaccaatttcatttctactgtcaaatttattgacataattttttttgtaatattttcatattatcttttaaatatctgtagaattcctgatattggaaaattttgtcttcattccttttcccaataaatttggctagaggctaactgattttattcacattctctaagaaccagattttaattttactaaattttctccatcagtttttattttcttttaaatcatttatggtcttataattattatttccctctgttgactttgcattttatttcctcttctttttttaatttgttaaggtagattctgaggtcatcgatttgagattttttagtgtgataaattttcatctaaatattgtaaaactgggataaaccatttttgatcatatttataatcccttttataattgctgaacttattttgctaatgttttgttaagaatatttgaatctatgttcataagcaatattggtttattgtttccttgcaatgtctttcattttactaacaggttaataatagtctgttaaaatgaattgggaaatattacctcctcttctgttttctgaaaatttttgtgtagaattgatattatttatttcattaatgcttggtagaattcaaaatgcagccttcagggcatgttgtcattgtgggaaaattatttaactaggctctcaatttcattaactgatacagagttattcagcttatctatttcttcttgtctgagctttgctactttgtgtcttttaactaatttgtttgtataaagctatgaataatattctgatattatcctctaatatctataggatttaatgtgtttcccttttttaacccctgacaatgacagttttgtcttccttttcccttgttctgtctggctagatattaatcaattttattgatcacttcagagagccaacttcagattttattgagttttctcagtttttctcctgttttctatttcactgattttttgctggtatcttcatgatttcctcttctcttgctttgagcttaatttgtccttctttagctgcttttggagcttaatttgtccttctttagctgctgtattaactgatttaagacctttttttatgttctaacatgatttctctgaattttcctctaagcctacttcgtgagagtttcctgcccttccccagtgatagcactacacatcagctttatgtctgtgcagtgcaggattctgtgcccacctctggggcaggcggcttctgatttactgctctttcagtggcagtatgcctttgcctgggcctggtggcaggtgggatgttgtttgtttctgtggtcaacgcttttggcagatgagtattcctgtttctcacataaatgcggttagcttttggttttaagactccctcagcagcagtttacccttacctaaaacggaggtgagagtgtttttttttacttccccaagaggcagacagcttttgtttttacccctccctcagaggtagtggatcatttattgaaccctggttggaagagtgtttccttcctctctatacagctgagggctttggctttctaagagagcaggttctaggaagtagatggtgtttcacgcctttgccctaaaaaggaggactttctaaagcctcctgtcgtgaccccatgaacacatggttgagagccacaaaaaagtgatttcaatgagtgcaaactacactttggtctggggctcccacagattttaaagtgtcatactattccaactttagcaatacgtatgtgttatatcattaccctttctttttactggcatatggtggccatccctttctccaatgctctacatatgggaaaacagtttgcgtcctgtatctcctcagaagagtttattaccctctggcattcagtttatctggatgccttttgacctgggctctctttttggctaaggagcagttttaattttggagattacctggatttttctgttcttatgggactaatattctctttcctatcttcgtttatgcataatattgataagaaaatctggaaataaatttaaataaataaaatatggccaggcctggtggttcatgcctgtaattccaacactttgggaggctgaggtgggtgcatcaattggggtcaggagtttgagaacagtctgggcaacatggtaaaaaccccatctctacaaaatagcctggtgtggtggtgtccacctgtaatcccagctgcttgggaggctgaggtgggtgggtcacttgaacccaggagaaaaaatttgcagtgaactgaaatggtgtcactacactccagcctgggtgacagagcaagattcagtctaaaaacaaacaacagcaacaaaaatggataaaatataagccaatgactttcctgaaaaggaatgtaatgattcaaagcaaaatattatcaaaattatgaagcaatgtataaaaagataagactacagaaataagttgagttattctaggaatttgttttagaaatagggcattgctatgttaatccaggctaatcttaaactcctggcctcaagcaatatgcctgccttagcctcctgagtaactgggattataacttgaaccatcacaccaggcaagattcgattaaaatttaaaaaccttccagtatacctccccataatatcaaaataaggtacagaattatgtaatagtttaagtagatccagaaatagtgtttggtaaaattcaacacctatttatgatacaaaaaactatttctgagtaagctttaaattactctaaattaaagtcttctacacaaatagagtacatagcatactaattggttataaatatggaaagttttcccttggagactgggaattgggcagaggcactaactccttctgtgtctatttgtcattgccttggatagcacggcctatgcaataagacaagaagaaaggtataaagcttacaatagaagcaataaaattgttattcacataaacctaatgtgcactatacatagatcctaaaacacataaactgtaaaatttaatgagtaagtttagcaaggaaatgaaatagtttaaaccaaattaaaatgtaaaaaactgatacatttacaatagaaatacgcatggggataaatttaagatttttcagagaaattaaagacatcttttctttttaaatagagggatatgcatattgttaataaattggaaagctcaatagttaatttttcccaagttgtcctatagacattgcaggtaaagcaaagtagtcataaagttgtgtgctcatgataatacctaccctccacctcatagggtccattaaggtatgacttcccccagacccaagggccggagtaagaaggagtagccaagacagaaaccatagtcttttataacctaatctttttattttctctttgcttctagattaaccaacctggctttgacatgttctccctcatgtgatgctacaactctcaattagattactataaaattttattgttgccccaagaacacttctacctctttgagaagatttagtatgtgttgttcttaatgtttaattattggatgaaaatcttctatcaagttctttggggaccaaaatttttgttacccaattatgaaactgtagccatattgtattttactgaatctcaagagattctaatcaatatgtcacattttaattcaaccattttcttcactctagttatttatcttattatgactacttgacactagtgatgagtgttaagcaattttttcaattgccttttttgagaggaaagagtggaatagggaaagtagtaattttaaaccagcctctgaatctttatgtagtatctagaaatatacgattttaaactgactttaggatgaaagccatatggcataaaaatatcacaagtctagttttcatatattttttgtagatatatacatatgcatacacataaatatgtataactttaaaataatttattcccatattatgtggtacattgaagatttataacttgggtagtgtatattctgttcactttacattgaagagccttattcataaatattaagagcaaagtgatactttgataaaccattcttaccatagaaagatatgctggtaaaccttaattttttagtagaggtttgtggagaaaggaagagaaaataaaacatccccttaaaaagtaagtgaactaaatattgcaatgaactcaaaacataaacagtgatttatttttaaaaatattacctctcattaaaattgaataaataattcatgtgaccacaatatgacaaaattgttttccatgaatttcctagcaataattttatatttcttgctgcatcaaatataaatgccagaagaaatgatatgtgaacactttatatagtaaatacttcagtttctttgaaaagaaatctttattgcttaattatatacacgcccgcatatatatatataaaactctatatacacacatatatacacacagacatacaatacacacacaaatacatatacacacaaatatatatatacacacacatatagttttgcatggcataacgtttcagccaaaagcagattgcatatgacagtagtcccataatattataatgaagcatatatagaaacttaatatacgacacatgatattgtcattgcagatcaaataagggaaatgattgaaattcagtaatagagcagggacatagagtgcaattacactctatgatgttcacacaacgataaaattgccaaacgacacatttctcagaatgaattcccatcactaagtgatacatgactagatttctcatgttatggttgacgtatattcagtttctaaaatcaagagaaattaaaaatataagaaaagtagccctcaaaatttaaggaatgcataacaatttgcatgatgacaagttcatttgggaatatcaagttttttaccccaacttttgggaatcataaagccagaaagtagggctcttacaaggagagtaagaaattcctatgaaccctctccggtcacagtcaggagttaccacagggtactcctaaatttatttttaatttttctaaaataagagaatcagtttccttaaaaatgacttcaacaatttaattattgcttgaaatcatataaaatgcttttaaaatagttttcaaaatatgactttttactgacaaaagcatgaatatgcatagtaggtttttattgcataatgacacattcttgcatatttgctaattaataatgattttttaatagtccagatatttaggactacgtttcccttcctacttagaagccagttttaagttagctgtatatacattactctgaatgtttacattatctccacaaggttgacattctgtgaaaaggtaggaattaagtagacttaagtcatattggggctgcaatttcccaagtcataataaaaagagagaatatttattctcaactccattgtaagaagaatatggagacttcaaaaggaatatctataattgtcccctatgccgtcattggttcatatgtggaaaagttctgaatgtattaaaatgtttgttccagtccaaatcaaactgtgtagtatataagcaccctttctttctctgctcactacaaccaagccctaaccataaattgggtgatacaggaaatcaacaagagagagtttaatagttaattattaatatagtaaaaatatgcctgcccaagccagccaattgataccacaaacaatgaagtctgtatatgtatacctatctccttaggctcactgtgcaagttctacagaatgtatagacactagcagaattgctagtatgaagcgtatgagcatgttcagttctgccaggtatcacccaattgctttcaaaaattgtaccaatttacactctcaccagcaatataggagttgtcattttcctatatctttgcaaaagttcaatatctgacttttcaactcttgtcaatctgatgaatgtaaaatggtattgaactgttgtgtttgcatttcctgattacacatcaggctgaacatcttttggacatgtcccatatcccttgctaatttttaattaggatatctgtcgttttcttattgattttggataattttctatgaattaaacttctataaaaattacattaactgagttaagagaccattgaagattgggaaaatgtttgagaaaatcattcttctttttcacagtagcagattttgttagttgaaaacctcatatccactgcctgtagagacagtgacagattatctattgtctcctcattattcattctctctttcttaccaacagaacctgatttaaatggaggctgtacttcttggctgtctttgtatgggagatcatgttacacaaggctgcccaatagaatacaagtatgagttgctgtttagaaattatggaaagactccttaagtagagtcagacttaactggaatgtgtatttgaccctccgtcttccttcttaccttttctgcttggaacatggcctcaatgatcagatatggtgaccatgagagtgaaagccacaccctgaggctgaaggtgaagaaaatgcaaggagactggagtattgaaggcattgtggagtggctgcactggtcctgaggtgtcaacctcaaaatctttactcaggtaaactgatgatagattcagtgacaagtaacaccccagggttatcagagatggggacttcacagaaaacacaacaggtaaaaatgtttgcttctgtgaagcttaggttccagtttggggagacagactataaatacaccgctgaataaataggtaatatagggaaaggtaagttaaataaagaaaaaataggcaaaataagggggctgccagttctaagtgtctgagggttggcagagaggtggcatcttcttagatagacttatcagtaaggcttttctaataaggggatgcccaagtacctgaacaaagtgaggaaataacccagagcactcaggtgaagggtttcacgtggagaggttatcaagggtaagggcttctagggagactgacaagcaaaggaggtgtgaaggtgtgagggtgagtgggagagaataggtgggagaccaagcttggggtccatactatgttggtcctaataaggaactttgattcttttgaggactagataagatacaaatgatatataaagtgtctggcaaatagcttgcttctaacatagaaaagtaaaggttctatacagtttgtatgccaatattctttgagctacttggaggccagagaacttgcagtctagtagtgtctgaattaaagaaggggtctcttggctgggtgtggtggctcacgcctgtaatcccagcactttgggaggccgaggcgggcagatcatgaggtcaggagtttgagaccagcctggccaacatagtgaaaccccatctctactaaaaatacaaaaattagccgggtgtggtggcatgcacctgtagacccagctactcgggaggctgaggcaggagaaccacttgaacctgggaggcggaggttgcagtgagccgagattgtgccactgcacactagcctgggcgacagtgtgagactccatctcaaaaaaaaagaagggatcccttttctgtatatgaatttgtagaagtatatcgccctgtcccctctccactgggcaggccccacactgagcccatgacttggtgcacagaccatgaccatggctccacttctatccgtggcctaggtaactctgggtagtgcaaatcagcataatcacatatggtggccctgaaagactagcattactcattttatttcgagctctgaatataatctgcagttctaaaatcatgaacatggaacatatttatagatgtctcaaattattatgcaagtctagtcatttgaacattccatcaacaaggtaccatcattgttgtccttactttttatgggaatattttaaacaaggaaatgcttatatttgcaaagccttgtataatttttttattcaagatttttttctaaagaattgtgaatgaggtttttaatacatctatgtcagtgaaataatagatagggaataaataggtgacacagcatacttgctttcctctccttactaccttttggtagtggatgattttctttttcttacatgaggtagttattatcacatactggtagtaccactaaccctttcttgaaacatcatttacattttagtgccacttttgtattatacaagcattttaaactcaaggatgatatagagattgtaaattcccaggatgtgaggtacttcctttcaccatgattaatacttttggcaggaaggatggaataaagaatattgtacatgccagaattttatagtcactcagtgtaccctggggggtggaagttgcaagaaagctcatattcctgccctctttatatatacatctattttttttgttgaaaaaacagaagttcaataggtccatgaagagattactgagtctgctaggtcctgctggtgcatacctgctgagacagggtagaaggtcacacagttatcctcaccatgctccaaggaggaagcctgctgtggctaaagtatgtgttcttattaaatatatattgtaaagtacctctgttgatactgttaaattcctaccattaaaaagttgcatatagtgaacgcagctaagttaatgtttccgtaagaaccttagtgttaaaacttgcttaatatgacattaatctaggattttgtttgtttgtttgtttgttttgctttggcacagacaaaaacacataccatgaatacatgtgtaattttaaatgtttgtaaaatcataacaaactacgctgagaacatacatctttatggtgtcatttgtgttgggcaaagcttggtttccctattaacaatataactgaagttctcacagctttctgccagtttgtggaaaggtcttgattcctatacacagattcagttgtctttgaaaggaaaataacaaaaacaacccaactggttatatgctatacatataaccaggctcaaagtgtgcattgtaaattctgttggtataaatctgacttgaagaatgtctatttacagtggttttattgaatgcttgttcttaatataggcaagtgaaagctgtggtattaaatctaaaatattttaaaatggaaccacagagcatgactttgatttaccatggcagatgtttctgattctagattcaagagtcagtaggttttaacacaactacaaagctctaaagaactataatgccaatagttgatctaaaaaaataggaagtattaatctttgtagattttaatgtcttaaaagtattaaaattataaaaagtcaagtttatcagaatgaagtgaatgaattaatgttatgtatatgttctatgacttgtttataattctaatatttaaaccaaccttttaaaaagactaacttttagaattaccataatatttaagattaaatcttgcttagatggtgggttttttcctctctggcatatgaaccgtttacttctaaaataaagctattttatcccttgtcatcacacagccataaaaattgcaggcagtcagaagttagcaatggctgcttcacagacccacagcaatacttagtaacagattttcaaagcagttcaaagagtccagtttccatctgtgtttggtgaaggatgcacaaaccttgaggccatctgaaaactcagcttcatctctaacacttggaataacaaaggtgttatttttcaaagctgcattctcccctcctggggtggctctgcagattcagttcagggaaggtgggaaacttcagagcaggtattctccttctagactttgcctccttcggggagttcttttgagggtgttacaatggtggcctcctgaacatgggttactgccaatagaggccaagagttaatgaaccttatagacaaatcccttcttctgattttctgagcaaaatatcagcatagaaccagccatctcgtttcttccggactaggagtgctgtttaatcaggagaaagtagagggtgctctctgcctacaataaactcatgattgctgaatgatgataatgtctccatttcattcagctgattttgtgaaaccaaagcaggaaatcgttgggaaagaaatggttgaacatccttgtttacagtttgctataaatacatgccaaatttcactgaaaaaaattgcatatctttcctttttttgtttatcagtctatgtattgattgtctggcaccctttttgatacagtgtgtttctaaagactatgtaacataaagttaatatgcaattaatgagatataatggaaatatagatatttatttgctatctttttatcactcaaactaagatggcaaagtcaagtcaagaagaacataagcagtttgctctttagttctttgaattcagctcatgtctcagaacttctctaggattatattttaaattgattttacataattcaaagcaatctcaaatgattcttcattgaaatccaaattccagtaactacaggtatagttttacttaggaatattttatttgaaaatatattttcataaaaccacaggttgatatgtcataaaacacgtttataagaaccagaaattttattttatagggctgacaaaaatataccttaatgtgagaaaaaagattgagtgaggtgatagaacttatgcataaagattataatatccttattgtatcaacattgtttcttgtttttttttaaaaaaacttcttcataaataagacctcttcataaataaaaatgtactcatttcataagtaaaatatatatttacttgataaagaaaactgagaaaattagtaaattaaaaatttttgcttttgacctcacattaaaaaatattttgatatggcaaagcctactgtctgaagtaaaacaagagattgttcatggtaacatttaagatataagtaaggtatataaaaacagatgcattggcatcaagctgtgaacttctttttcaggagactgggatagatggggatcaagcaaagctttacttctctcaagtttccagtcatattcccattcactctgaaggcagagtagaaacagcaatagtgtcaaatgtggaatggccgagaacaagactgctatttatagagagccaacatgaaagaggatataatgaccaatttttttctgcttttttgcatgtggaactatctttactcacttaccaattcttcactatcaatgcctgtacaaagaatgctaaaataaaggggatagcaagaagaagtcataaagagaatatgcattaaaggagggcaaccacaaaacaagataaggtacctaagagctcatagtaaatgtattgtcatttgagaatccagtttttgcagttcaattcatgctaaaacagttgttttaaatgtattatgatttttaaattccctgcatcttctcagtaatatctttgagtcttattttattaaaattataatttctgctcctaaaatattattttagtgatcatgctgacattaaaggcattaatggcgattctaaatcactttgttttctcatgggcttctatacaaattaaattttaggaactatttttatttccaaattttattttaggatcaggaggtgtatgtgcaggtttgttacatgggcaaatttcatgtcatggaggtttggggtacaggctaattttgtcatccagataatcagcttagtacctgataagtagttttttaatcctcatccttctcccaacctccaccgtcaattaggccccagtgtctgctatgctcttctttgtgtccatgtgaactcaatgtttagatctcacttacagtaaatgataacatgtaatatttggttttctgtccctgctttaactcacttaggataatgaccttcagctccatccattttgctgcaaaggacataaccacatttttatagctgtatagtatttcatggtgtatatgtatcacattttcttagtccactcccctgctgatgggcatctagtttgagttcatgtctttgctaaggtaaatagtgctttgatgaaaatatgtgtgcatgtgtctttatggtagaatgatttatattccattaggtatatactatgtgatgcaattgctgggttgaatagtagctctattttaagttctttgagaaatcttcagactgttttctacagtggctgtactaatttaaattcccatcagcactgtataattgttccttttttcttggcaaccttgccagcatctgctattttttgactttctaataatagccatactgactggtatgaatggtatttcattgtggtttttatctgcatttctctaatgcttagtgatatttagtattttttcatgtgcttgttggatgcacttgtgtcttcttttgagaagtgtccagtcatgtcttttgcccatgttttaattgagtcgtttattttttgcttggtgatttctttgagttccttacagttcgtgggtattagagctctgtcagatgcacagttgcaaattttcttctatcacataggttgtctgtttaccttgttggtcatttcttttgctgtgcagaagttttaagtttaattaggtatcacttgttaattttttggttattgttgcaattgcttttggagccttcctcatgatatatttgctggggctaatgctcagtacagtggttccttcccacagattttcttctagggattttatagctttaggttttacattcaagtctttaatccatcttgagttgatttttgtatatgttgaaagataggtggtccagtttcaatcatctgcatattgctaccagttataccagcagcagtttattgaacaggaagtccattccccattgcctattttcatcagctttgtcatagatcagatggttgtaggtgtgtggctttatttctgggttctctaacctatttcattggtccatgtgtatctttttgtaccagtatcatgctgttttatgtacagtatccttgcagtatagtttgaagtcaggtaatacaatatctctgctttgttcttttggcttaggtttgttttggctatttgggctctttttttggtgccaaattaattttagaatagttttattaattttgtgaagaatgttgttggtaatttgatatgaatagcattgaatctgtaaattgctttgaacagtatggcctttttaacaatattgagtcttcttatccatgagtatggaatgtttttccatttgtttgtgttgtctctgatttctttcagcagggttttatagtacttctcgcagagatcttttacttcctttgttagctgtattcctaggtaggttattttgtctgtggctattttaaatggaattatgttctggatttggttctcagctagaatgttattggtgtaaaaaaatgctacatatttttgtacattgattttgtattctgaaaccctgctgaagttgtttatcagaactaggaaactttgggcagagtctatggggttttctaggtagagaatcatatcatctgtggaagaggtagtttggcttcctttcttcctacttggacgtcttttatttttttgtcttgcccgattcctttgtctaggacttccagtattctcttgaataggagtggtgagagtgggcatccttgtctttttccgtgctcaaagagaatatttctagcttttgctcactcaacatgatgttggctgtgtgtcacagataactgttattattttgaggtatattcctttgatgcttagtttgtggagggtttttaacatgaagggatgttgaactttatagaaagccttttctgcttctattgagatgattatgctatttttgtttttagttctatttatgtggtgagtcttgtttatggaattgtgtatgtggaaccaactttgtatcccaggaataaagcctacttgatcatgttggattagcgtttttgatgtgcagttaagattcagcttgctagtattttgttgaagatttttgcatccatgttccttatggatattggcctgaagttttctttttttgtcattgtgtctctgccatttttgatatcagagtgatgctggcctgaaagaatgagttagagagaaaccccttctcgtaatttttttcaatagtttcagtaggatttgtaacagttcttcttcaaacatctgctagaattcagctttgaatccatcttgtcctggggtttttctggttgataggttttttttttttcttcttaaattactgattcagtttggtctgttctgggtttcaatttcttcctggtttaatcttgggagattggatgtttccaggaatttacccattttttcgaggtattccagtttatgtgctaataagtgttcataatagtctccaagagttttttgtatttctgtggggtcaatggtagtgtcttctttgtcatatcccattgtgtttatttggatcttctctctttttttctttattagcctagctagtggtctatatatcttatttattctttcaaaaaccaacttttggttttattgatgttttgtatgttttcttctcatctccactttattcagttcagcactgatttcttgtcttctgctagttctggggttggtttgttcttttttttctagttcctctaggtatgatgttagtttgttaatttgagatctttgtaacttttttatgtgggtgtttagcactataaactttcatcgtaactctgctaaggtatatctcagggctttcaataggttttaaccttgttttcatttatttcaatttttttatttctgtcttaatgttattgttttcctgaaagtgattcagaggcagactgtttattttccatgtaattttatggttatagtgatttacttgtgttcataatttttcatttcaatctttttataaacatttaatttattgcaagggaagggagaatggtgtttaaagatgtgaaacactatcatggatactatggctaagaaatgaagataggaactggagactaggatgctgaggctattgtgcagcctcaggatctccaaattcacctatcttttcttccctgcaggaatctaaactcaaaggagatgaggaatttgaaaaaaggtcaatgacaagagcttagaatgagctagttcatgatgctggtttctctcccagtatgctactggtacttttactcattatcatgaggtaaaactcttgctgagcagccaccatctgccttatttattcttaactttgagagattaagacattgaaaacatatgcacaaattctttatgcataaacaaatacatgcataaataagtaggtgaattaattataaaagcataagaagccgcatttagagattatgcaagtccagctcatcaatgacacagctatcaaattaaatcactccatgtaagagtaattgtgttacttaattctttgattctttttcctagacagttgttttaggaaatgggcacaaatactaactctaacaataatgacagaaaaaggcacctttttatgcattattattccagattgtcttagtcacaattcccactcattctcaataggacgtctagattctaccaacactcttctgtaagtacacctttatctttctcacttttatattattctcattcatactaccctccagaaccaccactaccattctgaaatcatttccttctctttttgcatactgtatgctacatgtatgctgtttatatataccagtctccttttcaaaccctgtgctgttggggaaatcttttgtgatgcactacccagctccagcctctgaaaccccacaacactaattattagatacattatatttattgttgtcacttgttgtctcatatttttctgcttttctgcatctgtttctcaactcacaaccttctaaaggacattggccagatactaaaacattttcaaattttcttgatcattagtattagtccgtgttcatgctgctgataaagacatatctgagactgggaagaaaaagaagtttaattgtatttatagttccacatggctggggaggcctgagaatcatggtgggaagtgaacggcacttcttacatgatggtagcaagaggaaaatgacgagaagcaaaagcagaaacccctgataaagccatcagatctcatgagacttattcactatcatgagaatagtatgagaaagaccagcccccatgattcaattacctcctcctgggtccctcccacaacacgtgggaattatgggagacacaattcaagctgagatttgggtggagacacagccaaactatatcagtgcttttcacatcccatgacacaggtgaggtgttcaattaatatttgagttgtgattgcaacttttatcctttctttctttgtttctttctttctttctttcctttctccgtccctcctctttctttctttctttctttttctttctctttctttctttctttctctttctttctttctttctttctttctttctttctttctctttctttctttctttcttcctttcctttctccctccctccgtccctcctttctttcttttctttcttccttcctttctttctttttctttctttctctctctcttcctttcttcctcccttctttccttccttccttccttccctccctcccttctttcccttccttccttccttttctctctctctctctcctctctctctctctcctctctctgtctctgtctctctctctctctctccctttctctctctctatctcttctttttaaagatttaaactctctataaatgcctatgggcttatgggattgacacacactttaggtcctaaaatggttacttagtcattcataaatttttagctaaaagtggcaactggtgccaacgttgcaataatcattctgtgagttaggtggtctaagcctttgagtttgctcattggctacagcattgaaaagtcattgtcttaggaagctaaattttattgaaattgctaccccgtttatattttatactatgatttataaaaatcagttaataattaacttttgctttcatgcctctttttaaaagtgctttagtgtttcacaactgtcccatgtgcatatattttacacacacctataacaatacttgaatacaatagatgtaagatatttgatcattaaatcagatatatatatgcagagcaaaacattcattgtgaattcatttcttggatatctaagttcaaaaagtgaatatgtaactagtaaattgatatgattttgaaaaacgaaactatgttccatgctagagaaggtaacgtatgggaaagaatcatgtacacttcaatataattaattatgttaaatgaaataaataatgttaaaccagattagaatagtattaaaataatatgaccaagcagagtttattctacaaatgcaaatttggttcaatatcaagaaatctatcagtttgtcacatctctctgtgcaaagaaagtatttgattcaacatctagttctaaaattttatagttacataggaattaaaagaaattgttagtatgagtaaaatgtgattgagaatataaatctgttagcaaatattgtaaataaatggggaatcagagattccttatgtttggttctagccttggtatttagcaaagctttattctggctgctttggcctcaaactttggatatctcaatcagcaattagtttattcaaggttatttctggcttacctaaacttgcacatgaactttaaccttgtgatagcataattcaccatttactctaatcaattaaacatttatataaactaacatgctattaagatttattttaaatagcgaactattcaccttcaaagagaaatagtcatctaaatgtaacttgaaatatttaaaatattgaaaatattattcatttaaatcactactatatatcaattattataagaatgaaatgctactgtaagtggtgatgactggaagcatgaaatattttgaataaaaacaatgattactaacattagatatttaaatgaaaatggatataaacaatcaaatactaagatacaaggcattaactaaacaacatttagaaacacattgtatcttttttgaacaaattaaagtttgtaaacatttaaaaaagtatcgcaaggccaaatatttacttataccacttataccactgacgcataataaggactgaaagaaagccaattgtgattggaattattctaattagatttactataaataatcaacgtcagcaaaagtcctggaatattactttttttcacaatctcacttcttcattccattcctcattcattccattcattcattctatgtgaaagaatgctctgtgaacacattatcggcattcagtgttctagttaggcacatagcaaagagttttgtccaggatataaaacggttacttcttttccttaaaaaaaaatcactgcttgcatgttcattatgttttatacattaaaataaggtatcacagagtctgctaagaaatgtgtagaaaatatgtctacggagggttgttaaaacctgtttgatggcatgacctacaaatggggtagatttttaaaatagttccttctttgccctatatgggctttaagagttaaccactttaaactggcatccacatttagagtcttctgagtttagtgtcgggataatgctactgaaatcaggtcatctcagatactctgaagtcgtttgctgtggccctcagtgaaaggactaggagaagtgaagtcacctctgatattgtagattccaaggaataaagactgagaacatgtttgacctgtttctgagatctttgaaaacaaagagattagtttgatggtagaatttatatatgagcagaattagtagccataataattaagaatacattcatttcttaattcattcactcattttctcactatcccaaatgtttatggatcataaaagtatatattatgaacactatttgcagaccttgtatctatgctaaaaagccataaatccaaatcggtaaagagattacaggttagctagaaatacagttttgaaaaattaaaggctattctattaccagtattattagtccatgtaattttttaaaaaattgttattttaaggccagggaagtctctcatagaaatctttgtataatgttcatgcttgtcatattcctaagatgactcctgggagcatttttacattttggaatcttgtatatttccagatagagaaagagtaactcttctatgagcattctctgcagtgaaaaagatcactggattggaaatgaagagctgagttatcatatcatctttacaataaattgctttgtaacataaggggagttccttattttgtttgtatttaaatttcctcagtaattaaagaagcaagttaatgcatatccttctagttctaaaattcaatggatttactaattagaaaaaatgttaatatcttggacttttcactctcctccttgaaaaactcatcacttaatgatcttcaataagtctccctacaaaaagagactctcaggtaactaaaaagtacggatttctgttatcatctgctttccataagaggcaactgattaccaaaacacccatcatcatattcacttatctatttttgccttcacggcagagacaaataaagttcattaaatcaatatgttcctctctattttccaggatttattacagttgtattatgacaatatgactgtgttttggtaaataaatataagtagaagtgatgaatcactctggttctgtgcctgttagagtccttgtttctcctttacctctttcttttctttgctaaggagacacaggaggacacatgtcacaaaggcaaattttagattactatgaaatttgcttgatctctaggtccttagatggaggacaatctctatataccccaatatactttgtatgaatgagaaattaagtttagttgtgctaagcaactgagagttaagaatacatttgttattacaatgtaacttagttaatcctgactaatataacctctatattgtggcttttctatcataagtttcttcaaaaaattgaggtgaatttacaagacataatatgcagatagctatatcagcattgaatatgttaatgattttatgttatcctatttttatttttattttattttttttttgagacggagtctcgctgtcgcccaggctggagtgcagtggcgcgatctcggctcactgcaggctccgccccctgggttcacaccattctcctgcctcagcctcccgcgtagctgggactacaggcacccgccgcctcgcccggctaattttttgtatttttagtagagacagggtttcactgtgttagccaggatggtctcgatctcctgacctcgtgatcggcccgcctcggcctcccaaagtgctgggattacaggcgtgagccaccgcgccaggcctatcctatttttcttacatttagggaaaactgatcaaagtttcttggccttcacctgactaattattttcttcttaattgattgccctgaatacttataaagtttccactaattgagaaagaggacttcagaaaatacaatgctgtttaagggaagaacaactctttaaatgtaaactttgcagatagttttctgtttgaaattattcaactatagttttacatgaacaacttatacatgctgatttatacagggtatttttatgtaaaatatctataagtgaatgatatagtttagatgtttgtccccttcaacttccatgttgaaatttgatctccgatgttggaggtggggcctggtggaagatgtttaggcatggagacagagcccttggtaatgaagaattctccctctattagttcccttgagaactgattgttgaaaagagcgtaacacctcctgttcactctttcttgctttctctctccatgtgacacatcggctctatgagtggaagcagcctgaagccctcaccagaaacggatgctggcaaataaaactcttttctttagaggctacccagtctcaggtattcctttatagaaacacaactggattaagacagtgagcttttaaagctcaaatcaatgatttttttaaaattatagaatgtggaaaatagccatatgagatcatttccactatagccagaaggataattactgcatgattccttgtatgtgaggtatctaaaatagtcactcgtagaagggcagaataccatggtggttgccaaaagctgggggtagggagaaagaaagtgttgcttatcaacaggtataaaatttcagttttgcaatatgaacaagttctaaagatctgctgtacaacagtgtgcccatagataacaatctttgccttttggacaaaaactctacagtctttggataatgtaaaagaacctttgtaatttatgtggtcatcattgattttcatcactttttcctctcataccagggttttagtcccacctaattttgtactaacctcctgccttttcacgcctctgtatgtttccatatgtcctctgcatagatgctatttactccttgtttggcaaaagacatcatcttccttcactatccttcttactgccattctctctattgttattactaatttcttcatacactgcaggttctttccttgtttatacttccagggtacatttcccatgcttctgattatgtgacaaaaatttaaatttttttttagaatattctttaccctttctattatgacttctggagagtaaggataccgtataattcattcccatatcctgagaaccaatcaatgaaaagccttcaaaaataaataaagtagtatattcttttacatataattttaataagaaattattgctggttactataaaggaagactgacaactggaaatcccattttggagagcagggtttcactttattgaatatgtactttcgtgaattttgactagaaattttggtagaaagcattctgaaaaaatctattcgaatttaatatgattaagattataaaaatctattcaaattatgcaatatttactggttggacacagttcagataatttccagtaattcagaagccatgtgaaatttggggctcagccatgtattttctgtaagaacttttttttttctgcaaagatgcattttgatactagctttttaggcaggtagaggaaaccctgatgccataaaatttctgacaataatttaagtgatatagatggcatgacgggattctggccgggaaaatactagaagtaccaagcagccatgatttcctatgctagttaatctgaaacagggcataaaatgcagatgctcctcaacttataataggattactttctgataaactcatctgtcttaatttatgtgttttgctttaaagaaattcaaaggctggacaatttataaagaaaagaggtttatctcacagttctgcaggctataccagaagcactggcatccacttctggtaaaggcctcagaagtcttctactcatgatggaagaggaaggggagccagtgtgctcggaggtcatatggtgagagaggaagtaagaaacagagaagggggggtgacaggttttttaaaacaatcatcaatcgttatgttgggaactaacagagtgagaactcactcattatggtgaggtcagcaccaagccattctttaaggatctgccctcatgacccaaaaaaaactttcagtaggcccacctccaacattggggatcaatttcaacctgaggtctaatgggtcaaaaatctaaactatagaaccatctaagtaaaatatatcatgagttaaaagtgcatgtaatgctggcaacacagcagacggtgcctgatttatgatagtttgactcaggatttttttgaattcacagtggtgcaaaagcaataggcattcagtagaaataataacatcattgtaagtggtaacaaggtcttccgctaatgttaaggttacatccaaataaatcaattgtaaagttgaaaattcttcagtcagttagggactgtctgtaatgatagctccttgaatatatggcaatgcttaagttcatctgaggtagaaccaattgtcaggaacaatgaaatgcatatttagatggtttcaactatagtggtagggtatttctggaggacttaaatgtttggttgtcagggtattgaggatcattataataaaaactacctcttaaaaattctttataaaggtactataataccttggagctcaatatacaatctgtgtgtgtttccaacctagctaattatcctagcttattttgtgctgctataatacaatacctgagactgaatagtttataatgaacagagatttccttcttacagttcaggacgctaggaagtccaaagtcaaagagtccacatctagcaagggctttcttgctgtgtcattccatggcagaagttgaaaggaaaagagagcatgccagagagagagagagatagagaggaagagggagagagtgtgcaagaggttgaagttgctgccacaagcaatttataattggcattaatccatttattaaagtggaactttcacatgctaagccacttcccattaagccccacctcccaccacagttacattgtggatgaagtttctaatatgtgctttttgggggacacattcaaaccatagcacaaatatgcccatattagcatatactggtgtttcttaactggagcatcagatgaagaattggatccgcaattagggatcattttttccaataaaaagttatactgataacaaacagcaacattacaattagtacgaagcgaaggaagaactgatttatgcttcaattttgcactcacaatagcacaaatcttcatggaatagaatgggctaaatttcctttactatttaaattgctattgaatatgaactgttaaattcatattctctcttgctgtaagtaaaacaggtattttatatcactctctctataaaatttaataatttttaaatttgtgtacatactgtaatctctttgctgatatggtgaaggccatgacttaaagcctttgtaaaatgcattcgtcttcttaacaaaaaacctgttgtttcaaaaaattttgataatgagggagcaggaaagggagtatgtcattcaatgcaattcaagaaccaatcagtgaactacagctcaataatatcattttggaattttaaaaagagtaattatttacttaattttttgtggagagagggcctggctgaaatcaacccaggctattcacaggcatggttcattgtagccttgaactcttggattcaagaaatattcctgtctcagccacccaagtagctgagactacaagtgtccatcactgtacttatttttaataagtataattttgctatctaaaaatcataatagtttatattaagttaatcaatgaaattcaattttttgaaaaagaaataaacctgctacttcaaagaaaagcactgatgacatttaataataatcttgtgtataatatgatccacctttaaggagaacttatcctctttccttccacttaactttaattcatattcagggaatgtttgcctaatatcacctgagtaaattatttcatttttcttagctacagtaggcaattatatttgttattttaataatatacaccctaaaagagaagtggaagaaaaattattcttgttttaatattttataatcttaaagtatgaagatactctcaatttatagaagcaaagcagaaaccataaatggaaaggtaggcattacatcaaataagatataatcaatgtgaatcaaacttttttattttaaatattaattatttgaattcagtgtgtcttttattgtcaatatgctgataatatgattgtttggcttcatacaatttcattgcaacacctactgtgtctaacacaataaggatatttattgataattttatttagttggaactaaactagccgtcacaaaattgacaagtggcctaaaatgactcttttaaagataatacaaataaaataagcacattaccaaaaacagcagagtaatagttctttcactacaagttatttcagccacaatgtgagctgaaaaaatgacaatgataagtagtgcaaaaaataagttgaaagtatcaggattttttgaaatacagatttacaaccactataataaatactgaactttatctagtatgtatatattttatgctacatgtattatacaatggtaaatataacattttcatatattactgtctttaataccaaacatagaaataaactaaatttagaccccggcattaaaatttgtttattcacaaatattaaaatatttttgaaatcatgaaccatgtctaactaacctgctcctaagaaaatatataattagggctaatgcaagtttcattaaaaaaattgtatgttgttcattagtaaatagaaataaaataattgacattgatttgtttcatttggtttaccttaatttctgtgtgaatattgtgtgatatacataaagcaatgtgttatataaatcatagataaatgtaatatttattggggtggtacttaaagtatttcagtgccaaggattcaagtacatttgtggttttttcttaaaagataaatatcatagtttgtatatccattggtagaaaaaacaaaaatggtggaaagaatacataataatgccaaggtaaatggtgaagccagagttcaaattcaggtctctgaattctgagactagaccctctgccatttaatatacaacatcacctaaagtcaaaaatcttaagttgcttttcaggacttcaaatacattctgactatctctccagcctttgaggtactttcatgcagttgatagactttctgggaagaatattatgacagcaaacaatgttgcatgtaatgattttggtgattagaagacctgctcctcaatctacatatatttctattcacacaaaagatatttgggacagaaaaattcttttaaacctgaaatttggtgcctaagttattgtcaggtcacaatagtgtaaaaattaaaatggtctggtctatttccatcttcaaccagctctttctattcaagaaacatggaagtaataaaacaacattaaaagtacgcaatgggtttcttaaaagttttgtttcattttgcttatcaaagttacaagtctaatattaatccttttgaagcctagtaagtgaagattaaagcattctaacatctatctataggtgtgccataatgaattatgatccttacctaattccatgtaatggaaaagctccagtaagtaacaaacttaatcagtgcagtggcacagaagatcaatctttgattcctatattcacaaactggttatttggtcacattagagagcaggctgagtgttggaacagattcctagaaatgatggatgtaattgtcaaagctgccagggtcaatgtataatgttcataaaagaaccaacccaattcaagcaccttccatttatcatttatgcaatttgacccctagttctctttataacatataaaggagaaacaactgccatgttcactccattggaatcttgtgcactttccactatcattcaggtcacagccttttttagactggggttatttgtacataactttcccttctctgagggcattgggacaattaattgaaatatggatttaaagaagatagaaatagatccatgaatctgtatgtaatcgccatgttaccatatagaatgttttgaaatccccagtcagaatctttctgattcatcatctacttactgttataatacacactcaactttgacattggcaatattgtgttgagaattattccaataaccagcattttacaggtgggtttttcttatgaaatttgcacgtgctaaagtgttaggtgtacaaaaatttaaaagaaaacctcaaataaatacatattaatgtcatatatattttcaattggagaacaatataaggaacttttatttattttgcttgaacaattggtcttctgtggcaattgatgaattaaatggacactatcacagatgagttcagttacaattatacatattattaattctagagtcttatcaagaaaaacagctgtttggaattcttggctctttgtttttagatttgtgtatttacaacacttccataaaagtgtgttcttactggatatttgcattagaatgtaagctcatgaggacaacgcttactcttggccagattttagatttctagaagaatgagtacattgtagaggctcagtatttactgaaagaaaaaaataagagaaagaaggaaagaaacagtaatacagaaaggaaagtgaacaaagagtataatgcatattattttaaaatatgcagatattgaagtgatttgtggggtatttccaaaattagatatgattcattatgatattattacccacatcaatgacactattacccactttctgaaactaaagcagtatatttcctaaattacaatagatatttatctgttttaaaaacagcaaggtgatcttacggaaaatgcaagtaacgtgaaaaaggagcaatcataactaaaatgatgtaacattgaaaagtgcctcactggttttcttcttcacttcaggataagtatatccttaaatatacttcaaaacactgtaataagaaaaatagctctccaaaacctaatactaaatagaaaattagtatcaagtgacctaaaatgtaacttaaatgaaaatgtcacaaacagtcaacagatagtttctaaatgtcaaaataagcctgtcactctgcaagaagctcagagaagcgtagtcctttctcttctgagtgtgcagttctagcaggcacagagataaatgagaaataataaatgtgataactgctgtaataggcaaatacagaaagtatactgaaaataagggcaacaattttgacaaacaaaacattaataaacaattgaaactacaaaaaagactcataattttaataaattttgccttcttcatctcttctcaagaaaacaaatgcctctgctttattgggtgacatgatcataaggagatgtaacagctctgatttgtattactgaatctcattttcctcatttgtgaaacacgagtttaaaaatccttttgaaggtcaaatgagaatatttgatattattgtgtaaactgtcaagtgctacacaaatattagtcatttttttccacaattgtttttagcatgtgtatgtcacatggttaacgtagcattctcataaaagaaaccttgaaatgtctctcctactcaatttttattttgcaactattttcagtcattattatgtatgatatgctttttaggggcatttgaattttaaagagaataagtaaaaactgaaaggagaaggacaatgaaattatgagattacagtcataataatttcattgattaatttttcatagaactatattatattgctcccaaaagattttccgagaaattaaaaaatgctgcaccaccatttgaaatggctgtacaactgctgcttaggttagagttaacttttttttaagcctgaaaatacagttatattttcatataataaaatagggaaaataggatttttagtgctacttgctctcaccagaaataatcataacctttaaactgttatttatgttaaattaaatttttcatttttactacctcatgttttagatgaggcatgtattttttaatgtatttccacactgttattgtacctgtatgataaactgctgacttacattcataccataattattttttagttttatttctctgttcctaaagaatcacagaagtaaagaattgtatttatgcttgtatttttcagcaaccttatgtcagaaaatgatgcatattactgtagaaatcatatatgcaagtccaaagggagatgatgaaaaagaaaacaagctttaaagtctacacattcctaacaccgcattaggaactcagcactcatagtgaaatcaaagaatgatcacactcaactccatctcagacctagactgaaatatcaaacttcaaaaagaaaagaaagttaagaactttaggctaatcaaaattttccaacatagttaacattattgctgccttcatcgcactagaaaacataaacaagaatccaagttttgtatatgcttaaataaaaatatttttatttctatccattatgacatataagcaagtagtaaaataaaagcacaataaaatgatgtatagaattgtctcagtctaaaaaaattcaattgagactattaattttatgaaaactataaagaattcttcatgaaattatattatacactaatttttagcattctacttacattttacatcatcaacaaattaaaggaaacatttaaacgttattttttcaattttattattctattacaataatctttttgacataagtatttcaaataaaacattcaaaataaattctaggtgctgatttgagcttttgatgtaatcatacttctgtacccatagtaatgtgaagttaaactttctcctcacaatgtagatcttttataacaacagtgttattcttttctctgacacaaaccctgtgatatcacacagtatccatatactgtatcgatacattacatggctccaaacagtaggcttcaaataaatgaaaaaattatatttgtgacaaaattctagaaaagggaatggtaaagtgggagaataatttctaactttttaactctgggtcagtggatttgggtacatttagatggacacacatatttgcacactgcaagtgtgcacatgtgtatatatatttatatgtgttacccaaaatatatggattgtgtaatcatttaatctacgcttttacatttatgaaatttgataagggattatcttacctatattcaatttgatgtaaagccaataaaatctctgtcaacattcattttaattaatccaataatgttaattgctgatagcttcattctccttgttccctgttggcaaccagaaaggtaattctccctctaacttagctgtcaggatgccatccaggagagattgtcgtcttgcttttcactgtgacctctgaccccaccactgtcttcctgtaacagtcctatcttcgggtatttaatgaactttatacatggctaaaaggttaaaagtgcagtgaaatgttaggccctgctgcgaaatgttccattgtttctatatgtctaattgacctttcatgttatgcaagacaagaaaagcaaaccaataggtttcttagtatccagtccaacacagtctttattattaatatgctaaacatgtttctttcaaggcattgacacctaaacactgctagaagtatcaaaatgacttctcattaataaccattatattaatcactgttgcccagaactagaatctaactgcgaaatcccctggtggaaattgctataatcgttcaaactacaggaatgaatatttttcagcataattactgctgtcgtcttactgaaaaatatcccattagatggcagcttttagttacataaattgtgttgattaatttttaatttccagcatttatatgacattgcacaagtaaagatctttgataatttaaatggttagctgagcaattattaaaataactcacagcaattgaaacattcatttacttactagaagtgccgtacgtcattaactcctgattaaaacaaagttggcaaattgcaagtgctgaattgatcactaagatatttatctcatggtgtttaataaaactatttgtgccatgtatgatgcctcagctgcaaggatgaaactttagtataaatgtgtcaaagcgaaggaatctaaacaatactggcaacatggcatctcaactgtgtgctcaagcgcacatctgtggctctaggcaggcaacttaaatgctctataacattaccatttgtatctaacccagtaactctttcatttaaaacaaacaaaagtttccatacttacaagaaaacaatgagttcttagtcttacttgtgtaatttatgtttttatcgacttgtttgaatcttcatcttaactgtgaattctcagataactttcagtttctttatcagtaaattgagaaggtaactgtgcttatttcataacgctgtactatgggataatataactcaagaaatgtaaatttgcctagataacatatgggatgtactgagcaataaatcatccttctcattataatgtctatcacaattttttcaaatgtaaggcaataatgaaaagataaatgttttatacctgaaaataaatgtcttttggttcttaatgtctctctgcattagtcttcataagctaaacacaaaaacacccatgtatttggttttcagctgagttgactatcaatttttagggtttaattaaacagaataaaaatttcaaaaatagatgactagataagagaaaccacacttttatcataaataataattattcccaagtcccactgcaactgcaaacttgaaagaaaaattaaatctgaaatattgcaatattgtaacatctaaaatttatattttgaagtcaggtggctcatgcatgtaatcccacctctttgggagactaagaagggaggattgctccaggccaggaggccgagaccagcccagacaacatagcaagacctacctaaacaaaataaataaattaattacataaactgggcatggtggcacacatctgtagtcctagttactcaaaagttaatgttgcagttacctgtgatcacacgctgcacttcagcctgggccacagagcaagactttgtctctaaaaaataataaaataaaataaaagcattttaaggtattttttggaagtttgtataattgctcccaaaacatagacagtgtttaaatttgagtacttcatgaggaattggtagagaaaattgttcatgttgttttccaaaaatcaggataaatttgttacagtttcatatacaaatgtctaataccttttgtaaaataaatgctgacaaaattcaagaagttgtctctatagccttttccctcaaaatattcatagttcaataggagaatgaggaggagcaataattacaatgtactgtgacaagtgttacaatatatacaattaagtaacttaagtggaaaggaagttcttaactgggtttagaggggttttggaagccttcccagggcggggacagttgagtggatcttgaaggataagaatttgcaagaaaagtgtttgggggaacaatattgtaggaaaaagaaacattgtttgtttcaatgagtgaagtactaagagtgcatatggtcccatctgtcccgttcttagaacatactaggagcacaataaatatttgtttaatcaatgaatgaatcaatgaatgaaatatattgggaaaagtgttccagaagggattttaaaaatcctgtaaatgaaaggtaaacacccttgactataatttttcctgtttttctctacgttattgtgatgtttttctaactcataagctctgttttacttttttggtcctttcacaaatatcatccaagtttcctgagacgactcctctcttgatcctggatattatatttatctctgatactcctttgtgtgtggtcctggatttgtatgcccactgatacataactcacctctggcactgctctgtaatacagaggcctggctcctgggaggcatggctcctaggctcccataaaattatttcctgtttgacttcagacaaggggtgataatggggagattagagaacaagaagatgagaaatgccagagtgtgttttcccctcctccttagcaggggataagtatccacagtgattccatggcctgccagatagttcaccatgtttctattttctacatagtgaccctaatcccagactcttctaacaccatttcctccaattgtcttctctaaaggatttggggattatttttggagatttaaatataaaatatgagtctatgtttccaatgcagtgtgctttctataatactacagtgttacatcattgaatatatttgacaaagaaattacaaactataactaatgtaagaggaaaataaatgatggagaataaggaagaaaaaaggcattttgccagtaaggaatgtttttgacttcatataacagataaattaagcatggattaaacagacagggatttctatttttcagatgtgaaccagtcatagttaggcagttgctgccattgatcagttgctctgctacgtggtagtagcagtgattcttttgctattttctccatggaacatgcaatttcaggcattacgtccctaatcaatgaaggaagaagaggataagggccccacaagtcaaaagtatcactttttatcttgaaagcaaaagcttccccagagttttcagccaaatttacgtaagtcttattggccagaagtgtgtcatatgaccaaacaattacagcagagggtaacaaagtaaatatttacattttttagcctccttagtacaggctggaaactgagactgagattgagtgatgggttaggcagccaacagaggcatgtaaaacggagctattttaatgacagataataaataaatgccagtttcaaggaaagtaagtggtgttaaagaaaaatcttttgctaataagattacttggttaatgtccaagtttgggacaaatgaagttaagaaatgtttgacaaatcataattcagcaaagacattttaatatgtggaaactgaggctcagggaagatgagtaaattctgcacattaatgcacctgattcatggcaatgccagttttcaggactaactttattgtaattctgggaggtgacagcatgctggcagccctcacagcccttgcttgctctcagcgcctcctcggcctccgcacccactctggccgcacttgaggggcccttcagcctcccgctgcactgtgggagcccctctctgggctggccgaggccggagctggctccctcggcttgcggggaggtgtggagggagaggcgggggcgggaactggggctgcccgctgctcttacgggccagcacgagttccaggtggccacgggctcggtgggccccacactcagagtggccggctggggccaccgccctgggcagtgaggggcttagcaccctggccagcagctgcagagggtgcgccgggtctcccagcagtgccattacaccggcgctgcgctcgaattctcactgggcctcagctgcctccccgccgggcagggcttgcgacctgcagtctgctatgcccaagcctccccccgcctctgtgggctcctgccgagcctccccgacaagtgccgccccctgctccgtggcacccggtaccattgactgcccaagggctgaggagtgtgggcacacggcagaagactggcgggcagctccgcctgcggtccggtgctggatccactaggtgaagccagctgggctcctgactctagtggggacttggagaacctttatgtctagctaagggattgtacatacaccaatcagcactctgagtctagttcaaggtttgtaaatgcaccaatcagcaccctgtgtctagctaatctggtggggacttggagaatctttctgtctatctaagggattggaaatacatcaatcagcttgtttgtaaatgcaccattcagcaccctgtgtccagctaatctgtggggacttggagaacttttgtgtctagctcagggattgtaaacacaccaatcagcaccctgtcaaaacggaccaatcagctctctgtaaaacagaccaatcagctctctgtaaaatggaccaatcagcaggatgtgggtggggtcagataagggaataaaagcaggctgcccaagacagcagtggcaacccactggggtcgtcttctgcagcgtgggaggtttgttattttggtctttgcaataagtcttgctgctgctcgctttttgtgtctgcactgccttaatgagttgtaacgctcaccgcgaaggtctgcagcttgactcctgagccagcgagaccacaaacccaccagaaggaagaaactccgaacacatgcgaacatcagaaggaacaaactccggacacgccgcctttgagaactgtaacactgcgagggtccgcggcttccttcttgaagtcagtgagaccaagaacccgaccaattccagacacaattccaaactctttaaactttcttctataatgtatggccatgatatggtttgtcatttgctagcaaagaattcttgaatcttatatatgcatacaacctatccataacactaaacaaattatttccccacccccacaatccttatagtgacttttgtacttcaaagctgctccttacgttaaagaaaacatgttttcattgctatgaaattttaacagaaaaataatgttttccctaagaccaaatcttttagaaatgatctgagttgtacctagcattaaaataatagaggaaaatcttgaaacaacttaatactatagtctgtattcacattttggctcactgttaccctcgggatatttttgcactaaattggtgctgtttatgtcttctaagtgcagtacagataattaattctgatgatttctaacaatttctgcaatgaaacatcacactaaatgtaactaatatttttcttattctgtctattagagtgttacataaatattccattcaactttatagttacagtctggtatctaacatagaatagatgttctcttacaattcttttaattggttctttcctagccccatctgttattttgcctcctatacccctgcgtcatgaccaccaccatgctcttcccttgtatttacttcccattaatcctaatgggtttaatgggaacctaaattcactttattttaaaaagcactgaaggtttaaattgtaaggattattagtctatattaatttcccactctttgattagtatcttctactacatgtattgtggaaaatttgaccctctcatgtctgcttaaatgccagagctgggaagtacattggcatctatatcagcaggttttccattttggacatctctatttagaaacctcctctttgaacttcctcctgatggaattaattctgtatctgaataaattttaatctatatgacatgtgacttaaagacacactgagtctatttctttacatttttaatagtaaatggaaaggttgggttatatattctctgaggcgaatgaagttctaatatttggtatttatgtgattttttgtttgccattagctacctctttgaactgtgtctaccatgattagtctccagatcctttaacatggttattctttaacaaagtgtgcttcaattaagtaaatcatattaaaatgtaagtcagaatcagcaactacaataatacattatgcagacaataatagctactatttaataatttaaagtgccagacaatgttgtaagaattttgtgtgcattatttcatttaatcttcacaacacttccttgaactaagtgtgaagcagtttgctgtgctctggttaccaacatgtcttgagttgcatgagactgaacacattcatacacagcaaattacatgaagtggattgattacttgataggcggcaagggacaacagaagtctaggattcagtgtgagctggtcacccaatgctcaggcaactctggggggtggatggagccttcgctgcatgtgcccaacttgttccacagctgagggtacaaatggggcaaaaggcagcctgctccaggttacatacctcgatattccataactcacctgggcaaagcattgaagggcattctgttctggggggcctggaagagagcctagcttttcaagccagcttcccctttatctcaggatgttgcattcctaccatgtagtataattactctttagaactacaagtgagaaagtgaggagaactgggtttgtccaagttctcagagaactgtcccgcagtaattctcttactgcttcatttaatgatgagaaactggctcttggaaatcttgaattttccatgaactttccaaagctcaagatcaatgaatcctcttttatatgtattagtttttattacctttcccatatagttccatttaaaaaattgttaacataaacttgctcccactgtattaatggcttcgttctcctataatgcccaaatatttatttaaacaagattttaaaacttgccttggatggtcaaggtaacttaaaaatttaactattaaagttaaattccaatgaaagttcctcatgttactaactcaaaacctaatttctgaaaataaaatatattggtcaatagttccatctaaaactcttaagacaaaaagtttgcagataacttccattttaataggatatattaacatgatagggctatattaagcacagtttttccaaacactgagcacctttgttggattcaatgttaggctttcaacatttatccaatatcttaatattgtcatatttttatcatactctcagaattaaatgaagcaaatatacattcccacatctgtgaaagtaaatgtttattccgtctacttacaatgctcagaacatttgtcacctacatgcaggggaaagagacatatttttgtagagttaatttatttgaaaagttacacacattgcataaatcacctgatttacttttgtaataagataaaacatgagatttctccagaaggtagaagactgagattgaattggcaattttgttagattaataatactaacttcttacattaactttaggtttactcttggtttaaaattaagttattattcaggaagcttaataatcatcatttcaaagttctgaattcacattataacacagtagggaggggttgttccatggttgttctccttaatttaatttttctgaagtgataacaacattaaaggagaagatattctgatcagaaataaaatcagtgatatatgtgacttccatcatgtgttggaatagtcacacattctctgaggtttccagtgttgtgaccagttccccattttcccctgagaagccttcccacaaagcatgtcaattattggtcaatgctaaatttctaaaattcaccatttactctttgcctaatcattatgttctgcatgatcatagtcttacaaaaaggaaccaggacaaattatggaacttcatgtttacacaaacgtgatttctggtcagtaacaagataaagaattagccaaggctggcagtttgttctccaaaatcaactctagtgaaactacaaatatgaaacataagtaaggattccaggagctaacaaccaccaccacaaaataatccctttgtaaaacccctagaaagaataaaggatgtttttatctggatatatcactgtaacctgaggagcagaattgcaggagaaatcaaccagaagacaggccagaggaaatccttttaaactctacccatatgcatgccagtgctagagtccttgagttactttcagggccttaagtgggtaaacaatttattcaaagagacattaactgatcaacttctataatcattcctccaaatcctttagggtgtagatttttacctaggtgtaaggactgatactaatgttgtttcacaataatgagttaaatgtacagccctgctcatagctattgcctggtagaatagcttcaaacagatacaatcaacactgagacctgcccctggacatttatcccatactgtaaggagagtggctgacatcccaagaaaaaatgagatcacagtcgaaaataactaaacacctaagtaagaaaacctcctcaaaagaggacctcaaactgaacaatgtaccttacctgccactgagttacagaacaggtagaatgcagatttaaaataagcctattaaatatcttcaggcattaaatgatggcaatagtaatataagattactttcaccattcatccaacacagattaatttctctagttttgggtttaccaaaaccaaagaaacagtagcaaaatgtttgtcactaaaactagaggcaatatatcataatcaataaaacagaaacaaaacaaaacagttttttgtttatttgtttattttattgatttttgaacccttgtgttttaactttgtggtacaccaacttttggaactaaagtgatataacttcccagagtagtggtaaaacagccatgagacagagttgagcccataactaggcaaatttatagattatcatgtgagataatgtacacaaacatatttacatacatatttatttttcctgagtaatacatgtacataacgttaaaatgaaattctacagaataattaaagttgaatgcagctgtctcctgcatcactcttccattgtccaagttcagtttttacatcaatgatttgaaaacattaggcagttacttctgattcttctaaaatatatgctccatgaggacagaaattttctgtttattgactgtagtttcacactggcatgttggaaactttcttcaaatgtctcgctcttcttggacgcaagtgaaaacctggtaatagaatagaaccattctatgtgccttaacagaaggtggggaggacacttacccaattgcagaagttcttatatcagagtaggggagaagacagagggctcagtagttcaatgcatgtgtcatacagacctataccttatttctgtcctcaggcaaagcttctgttttctagtctagaggctcttggggattctgcagagtacttcttggctgaattcccttcagacattctgctgactgtggctttagctgctctgctgccatgcaggtgactttctctatctctcatgacattaaaggttttttgtcattagcagtgtatacttttttcctctttttttttctatttactatcatttatgaatttaatgtaggtctcagaggagagggtagaaaaaatatgtggtaggtttgtcactcatattgacaattttcatgaaatttttctgatatagaagagttttctagtttttatgtcactgttgagctgccattttaaaaggccatactcccaaaccatcagctatgttcacttcagtctctaataggcagggaggggcattaggttctttacagggccatctcaagcaatggcaaatgaagggcagttaaaaaaaaaaagcggttgtgtttgctcctatttaaagcacaaaggtagagaagtcggagaaaagtaggatcatgcggggttgcctgtcagttccagggactgatgttttacatgtaggtctacagacatcatcttaaatttgaaaaacaaaagctgaccattttgaaaaaggatctatttacaatttcattaaatgaacaaaagaaaaaaaagtaatgaaaaataaaatgggaatgtgaaaatatagtctcagatcacagagatgtaagagattatgcagcatattttttcttatttcctatcggattataaaaactgtcttagctgcttcaaaaaatgctgatatataaaaaaaccttcagagaaagaaattaaagaccatgaaatggacaaataaatgtgccattcactgtggtaatatactggtagagaatagattgagctctgagtagttagtaagcaaaagaaggcacagtgaatttcatagctttcctaatcagaaagagcatagcctgctggttacttagaggagttatattttaaactttttattgacttaaaatgtttcagatgtcagcaaatttcttacctgtgaatcaataatttcagaagaaatacagtaggtttgtaggggaaaaaaatgattttttttttttttttttttgagacagagtctcactctgtcgcccaggctggagtgcagtggcgcgatctcggcccactacaacctccaccctccaagtttaagtgattgtcctgcctcagcctcctgagtacctgggattacaggcggctgccatggcacctggctgtttttttgtatttttagtagagacggggtttcaccatcttggccaggctggtcttgaactcctgacctcatgatccaaccgccttggcctcccaaagtgctgggattaaaggagccactatgcctcaacaaaaaatgatttttgagtaagataaatatgattttcacactgggccacatgccctcagaactctgtcttaatttttcatctttatcttgtaggggtttaattgtatgttgtgtatctgacacacagatttcagtaaaggctgactacattttcaaggctgaaatacactatcatcaccatcatcttcccacccctctctcctatgacacaccgacttgcagtttttctgttttgatcaaaatctgtatcctttttccttaaggaatttaggaaagcttaggttcctaaatttaggtttgattgtacaaggcacattttagagtaataggttaaagatacacaactaaaaatgttatttgtatcttttgctgagattgggggtacccacaatttttgtgttaatgctcacaaataacagcaatatagcataccattcccatgcatcatatttaactatctaattgcaaattaaaacaataggaaaatagaaagaaatgtagaattcatatcaatggaaattgcacatttttatgaacaaatgtgatctgaacacatcaacctgatttatatgcagagatactacttctatagagtacagaaagaaggactaactacagtttcaaggcacccttgaaaataattattcccatgtcctccttctgccctttttcttcttggtggtcttcagatattctttttctttaatagcaccacaagtagtagggggtaagaagaaggggtaggcaaagcaattttgtgtacagttatagatatagccttttgtagtttaatttttgaaactgcagcctttggttctttgaatctatttacacagatgttggggaagacggcttgtaaccatctaccactggccttgtggtcacctttgcctttaagcaatctctgggaggtacattaaaaatgattgtattagacacccatttctaagacaccatgtttttattccacgttctccttttggaatgtaacctaaccccatattcttaagacacagggatgtttacttagtattatatgattagtccatttggagacctgtagttttctcattttaatatcagtagtttatacaatgtatgtggggtaagctaactgcacacctattatgctactttaatatttcaaaaatggtggaactgaattttgacacataatgtcagcaattagcagtaaagagaaaatatatcttacctgattttaggcttcagactttgatattaagaaaaatattttcagatggtaacattgaataaaacactaactgaaatataaaaatatgtggaaatatatcacaatcattaatggtaatatcattaaaagttaacaggatattttgttttctcttttccatcattttgctatattggctactagaagaaccattaaggaggatgcaataaaacacagtttaattttgtctttaaaatcttgttatccctcactccctctctctcgctcttttgaatgcagaacagtaggttatttctgattcttccccttagggatgtgttctgttccttcagattttgcagatgcccatgtcctgctgctatgccaaatgcttcatcctcctaggagtttttacctggccaggtgtcatggctgccaagctgaaggatgaacactaaattgaacagacagggagatgtgtacaacatggttttcatcctccaagtcagaggtgttacatatatgatggcactgagtaatcagcaatagtgactaggcagtttctctgctttggcaaactcggatctcgctctctaactggtcatatggacctcctgccgctatgcctaataactgcagctcagttacctacatcctttctcaccttttcaccaggaaggaagcattgtctttgattgtccatcaggactaatcctttctcagcatgaaacttgttagcataattgtagagaaagctccaaaaaaaggacattagaagttgttcctttttaaaaatgtatgtaatttgaatgaaaagttactgtgtgtatttcgctaatccagccgttaaggtttcttccattatcatctttttcaatctttatattttcattatttctgtgtaattagaaacccttctcaactctaagaaacaataataatctttattaacgatagcataatcgagagaagttttagttaagattttttaagactcttatctccaaaaaaaataaattatgaacaattccagttacttttgggtcatctttagtcatataattggattgctcatgacttatttaaaaatagaatgaaggaacttagttctgagatctctttccaaaagaactatgaagtcactgaaagcctgtttattcaagagaataaactgagagtgccaagggtacttgcccataaagtgaatgtgctgcaagctaaaaaaataagataaaatgggcagcaaatgtatgcttggatgaatataatttctatttactaagataattatatattgagcttttaaaaaacagagaaagccttaaaattttttatgaacagaaggggaaatattatcatgggtatcctagtttaaaaaatataacttacaagagggtaatgtcaatattcaaggtaaaacataaatattgaagaaaaagattgtacaaatggagaataaaaatattatatagtcatctatccatgtactgttattattattaatttgttaacctacggagccatttagcttttgtgtttttgcacaagggaaacggcacagtgtcagacaggtaattgaagttatctggggctttgtttgatccaacttgtatgtaaagaaaaacaagaaggttaaaaaaaggactttaaaagctgcaattggtgcccaagacacatcttgacaagtataaaaaatataattaagattcctcgaatattactgaagtgagaagtttctactactctttttagatttcagtgaaaatgtagtgtactttgataatattaactttgcaaaggtcttgttattttttaatggtattgttcagctccttatgtttgaagataccattttcaaggtcctagttcaaaacaacttttgttttgaagcagagaattcctagtgcaaccttctcttgttagttttgtccagtgtttatcattaacatgatgaccatgacacgaggcaaagtaaaaattctaagaagggtcttaacccccctgcaaaagaaaacaccgttaacatttgttttccccaaactaagaacattttataaaaattaaaatagccttacagttttaggttagatatcatgagttcttccttttcattaatgatggaaaataactggaaattgaatggttaacccattaaattagttaacccattcagttttagttaacccatttctgacatgctttataatgtaactttgatttggaatattggaggatttacgccaaaaaaaacctcaggctgaatttgatacaggtgggctaggggaaatccccaaacatggtgggacttcaaccccagccagtatccaggctcttgcaccatagtgtgaaggatgagtcagaaaatagtgaaagtacagagatttattgcaaaatgaaatacacactcaagaaaggggagtgtatgcctacccccgagagttgcacaagggagtttggggctgctccctttatggatttctttaaccaaggtgtggaatattcatgatttttgggaaatggtagagatttctcagaactgtggtgccatccatttttacaccagatatgaatgttcctggaactttcatggtgttggtggatgtgtaatttagtatgtgaacgagcatataatgaggtcctaggtgaaacctagctcaaatccagcaccatgttgggtacagttgttcttacccagcttggccctcaccctggtttttcggagtcttgtcagcatctactttatgcagctctttggacaaaggtttttttgctagtcatgtgaaactgctgcctgggattttctattctgcaatcacaatgtatttttcctgtctcaaattcatatgcgcctttctcactgttctgctcaggaaaccatactctaggatgttcttttgcttaactttttaaagagcattggtaaaccagtttcattttcccaaatacttctgagaattcctgagaggcttatacatgtctcagctaaaatcctggcactggaacactgccttctcagatgcatgttattgatttctttctttagataagttcttacagggcacaactgcatgggttccccatgcatggtgcactaaagaccaaaatcgaatgtttaaaacattttaagtcttagatatagcataaaagggtttataggatagaaaacaacaatttggacacaaaatattaagtttttttttaactcttattcgtaatcattttgtaatttgtcttatcagaaattagactcagagagaagaaatagtgccccctcttcatccaggctaaaccatctcaaacacctatctcattatttaccttgtataagatctccatgtatgagctcccattaaatgttgcaaaatttatacaaatggccctaagaaagaatattaacctgcagagataaatccaatgtggaaatggtcataattcagacaaactttgatattgttatacagagtacttttccttgaaaccctatagttctggccgtctgcattgaagatttttttttttttaaccatctcataaccaaatggtccactaggttagattttccaggatagagtgtgactaaagagtcaataatttttgcaacagagaaaaccttagaaataagcttagaaattagtttgaccaaagtttcagagatctcaagaccaatcattagggcttaatctcagactgtaatagtgttttctacagaacaatggctttaagtacacagatattttcacatttagtgtctattgctggaaagtctggtcctaaagtaggagcagtggatgcatttcttctttcataacaaatttgacactcaggagataataaccttatgagaataaacagtattcttcattttctttggctgtctatacccacacgaaattaaatatatgaaggatatttcaaaacattctggaaaaataagaagaatatttaaaaaaataaactttaaccaatatcagtctttgacaacaaagttaaccattttagccatatagtataattttagtttctaggaaaatgtatgaatagggaaatgtttcttacattatgcatattttctcgagtgatgtcctagggactcctgtaaaatacctcattgattgaattataactataaccttaatgcaaatggtacattagagcatttttttaaaaaaagaacacatgtacacattggatggtcttccaattgtactgtttcttatgtatgtgtgtatgtgtatgtctatgtaattttaggtagttatagagattagatattggacaagtaattagaaagtaaccagattttgtttgtcataaaaaagaaaatgattaattttaattgaatttttagttgaacagtaaaactggataagaatttaccctattcagggaaaagatgtactgtgcttttcagaccaaaactgttctttcctgagtgacccagtgttggcctttactgcagaaatagatttgttttggtagacccctgtagccagctacctgcagagagaaaggaatcctgctaaagagaattcttaatacagtagttaaatattctttcatttgggtgaagtttcacatatgatattcttttctattcagcataattataaacctttagttttaatgcactttcaaaataactaaaataattataaaaattaacaagataattgtatattcctcattgaaaagttttagcctattcaaatctagcaagtctgctctgaaatacctgagaaaaaggtgtaaaatgaataagaaaagaaaatacagcagaatgtaccagatgtttttatgtgttggttgtacatatatctttctctgttagcttttagttacagacagaatgcagtgtacaaaattttattcacaatagatggccatgcatcatatattcacatatggatatcatttctctgaggattgaaatagaaagataggaaaacacaatatggtgtatatgctgaattctatatataagcaaatgtgaattatatagttacatgctctcttcaagaggcttcttatcactatctccctgggtagtgtagggattaattagttaaagtttgtaggctctttgaagctgggaaacactatggaagtgctaagcattatcatggtaacacgagagtgaggcataagtgatttgcaaccccatcagctctttgaaatgtgtgtctagcctgattcacagttttctcttacagtgttttatggattggaaagttcttatcagatttgaagatgaaatgtgttctattgaaatcatactaatctgcacaatcaatcttttttctatatattagtaaagtgatgtttctcaaaatagaagaaaacttgggatatgatttgaaaggtaatttaataaagtagaattttgacatcaattataactcatctattagcatttgattgactaagctgtagctctcttaattagcgcaactgaagtctagttaatttgcataaaggtagctattcccatcttttatactttaaaagacagtctggagactagtcactgtttccataaagcttatatagattttattagcatgttccaatcattcctcactataataatgtcaattctaagatgtaatctgctcaggatttctttaagtaatgttttttactttattttttatttctgtttttactttagattcagggagtatatgtgcaggttagttacaagggtatattgtgtgacactgacgtttagtctactattaatcccatcacacagatcgtgaacatagtacccaacaggaaggtttttagcccttgccccatccctctgtccctcttttggggtccccagtgtctatggctcccatctttatatctgtgtgcactcatgaattaggtctcacttataattgcgaacactcaatatttgtttttttgtttctgcgttaatttgcttaaaatggcctccagccgcatccatgttgctgcaaaggacataatttcgttcttgttatgactgtgtagtattccagggtgcatatggacatattttttatctaattcaccacggatgggctcctacgtcgattccatgtcttcgctatggtgatgagcatgagagtgcatgtgtctttttggtagaatgaattattttcctttgagcgtatacccagtaatgggattgctgggtggaatggtagttctatttttagttctttgagaaactgcaaactgctttccatagtgcagaactaatttaaattctcgccaacagtgtagaattgttccgttttccctgcgtctttgccaacacatatttgtttgtttgtttggctttttagtaataataattcttactgatatgagatggtatcttattgtggttttgatatgcatttttctgatgattagtgattttgaacaccttttcttatgtttgttggccacttgtatgtcttaagaagatattttaaataaacatagaattacttcctctattcataagtcaaattctgaatatacccttctgtttcctcctactgcatcattttatatggataatgagtcaataaaatgatgtactagttatatattttatttcacacttatatttgtaaaatgtttttctttgaaaaaaacgttttccatttttttaaaatttcttggaagtgacaatggggacagacaaattttgaagcaattactgcacaaggtgattcaaagttaactattgttcattataaagttatctgtttttgaataaaatttttaaacattataaatacaaaacaatgtaataaaaagcgatttaacctcacctagaaataattaatgcatatcttgtcctatttacattacatttggttataattgaaatacaccccctcaagttcatttccctttctccatttccagaggtgccattatcatgaacctggtattacctttatatttttataaatgtatcaaaatacgtctttctaaataatactagtgttttgtgaattttcaatgtttatgtgaatatcacagatgggtattatttcacatatttttcctcttaacattcttgttgagagctaccattattattctactgaattccatcatgttcctaatgagtttattgaaatggtacaatagaaacccttctctacgtctccaggtgcacgtgtgtgagagtttctaatgaatatactggaaggatagctggattgcagtgtatgtacagttttaactttgaggagaccaaatatcctcatttgctcccagaagtaccacttcattactattgttcctccatcctaattggattaacatatgtcctggatttttcatttttaatgaactattattataagttacattgattaaagccagcatgggtttgttaaatgttgattttgcttaatacttacagctattgtcatggttctaccattatgtgatgaaaataaaatgttaacagagttatgacttcaatagggggttaagtctgaaaatcaactttgttttcctgacccatttcacacaaaacatagataatgcttctctttcaaggacagcatgcagaatgcttgataataaaccagtatccactgagtgagtggtggctagggatggctaacttcttccaatcttgcatggtgatggaggaagtacttgacagtagttttttatgcggtctgcttacatgaaactgccagaccatcatatggtgggtttgggaaaaatgaaggaagtaataggctagatatatgtaaattatgtgctgtaaatagacgctgagcacacagagatgagttaattggtctggctacagtggttttgtcatctctcgtatacctacaactatttatttgtaaattgcttggtaatggcgactttttaaaaaataatctgtttcagcagcaatgacctaaaaaatgcaagtacatatttagtttaaaattactgaatttccctttcaatccaattgttattgaaaaaagccaacaaacacattgtacagtcacaaaacttgcacaatgtgtttgttggcattttcagttcgatccacgattgggaccgcaaggctaacaatgatatcctggaatccagaagatagaaagctgaggggaaaaaaatgctgctatttcagaagtgaatacttagttacgccaagaaaactatgcctgaagatgatattttcataggtttaatatgtgaacttagaaaaagtaaacatataattctgagaagcatggcttttttagattaaattactgtttttaaataaattgtgtgcattttaaattaattaatccaattttaatctaatttttctgattttatgaagtatgcatcaataattgttactatgttagcttcattagcaacagaagaaatttcaaaagtgttgaataatgctgttttccatctaacggaaaattagattaaaacattttccatctttcaatcaatcattggaaccaaaataaagctgttgaaagtttattctgccaggagtaaaagactgaacaatatgataaatgttttctaaagttcagttaaaaagctaaacattgttgatagcctttttattggtgacgagaagcaactttggaaaagcttgaaagtaattttattaaaaaatcaatgaaaaatgaaaagaaacacattttgtagaaaagaaccatggataattatggctacaaaactgattaatgcatataaatatgttccagaataattattctgcctgctattttttaatatttaggtaacaaataaaaataatttttctgttttgctttaagataagtaattatggttttgaatttttgaaggattttcttttcataaatagtttgaagagaactcttttataggcccatcagtatagtaaaaacaatttgtgagtaaataatatattaaatgtgaaataattttttatattttagtacttttatattctaaaaaagtttcagtttgaacaataaagtttttagtcaccctaactttactaaatatcttcaaatagttctgtggattgagggaacaaacttacttttccttacatccttgactgcacttggtattattagttgaacagttgccaagctaatgaatgaaagttggaacttcatgtggttttgacttatatcccctgattactaatgagctccagcatctagtcatgttttattggtcatttgactttcctcttttctgaaatggatctaactagtcacttgtcctgctttcttctactgggttagattgtctatattttttcttgtatatttctgagagttttttgtcattttttttggatattggtattttacgtatatttttaatagtgcttttctggagctttaaaaatacccaagataatttttagaacttatgatctgaagattttcaacaagccaacttagaaattattttgtggctataatgctaacttcaaatgaactaaagaattttgccactttagaaaacatacttaaaagacattcattagaaagtgctaaagtgctcaactctatccatttaataaatattgcacttaaatagtcattttaacaaaatcatttacccttacagtaagaaacaattattaaatgttttaaattacctagctcctggatggtttactaatattttgtaattgtcattttggtagtaatcacttagcatacttgttaaactactggttctccaagtctcatttcagattacagaaccaggattttgaaggaaaatacctagaaatatctgaattttttggccgggcgcggtggctcacgcctgtaatcccagcactttgggaggccgaggcgggccgatcacgaggtcaggaggtcgagaccatcctggctaacacggtgaaaccccatctctacaaaaaacacaaaaacaaaattagccgggcgtggtggcaggcgcctgtagtcccagctgctctgaaggctgaggcaggagaatggcgtgaacctgggaggtggagcttgcagcgagccgagatcgcgtcactgcactccagcctgggcaacagagagagactccgtcttgaaaaaaaaaaaaaagaaaaaaaaaaaaagaaatatctgaatttttttaagacccacgtttttatttggggatgtttggaaaactctgctttgacgcataggagaaagtaaaaaacaaaaacacacacaaaaaaaacaatgaaaagcaaatcaggaatcaggaagaaataccttatcttttgctcaccccctccttctcaaatcatctgcctttattttcttttccattcttaataaatactattccaacaatctagcatttcacaggcataagaaacctgctagtttgcaatttagcaaaaagtaagaaacctatttctgaatattttctttaggaacataacatttctagagacacatttgtgtttcagttaatgctatgtcttgctataaaatagcagtatttaacaaaaatattttaccactgtggcaaattacctcctgtaaatgttccaccgcaactaagattatattgaaaatttggagactgacattttgaatttcacatattcatggaagattggaaagcatcttcagatgtcagaggctataataagagttattacgcttattaacttccaaattgttttgtgttaaagcagatgcgtgggtactggatacagaggtaggccactgaagcataactgtggttaaagttgtaaaagatttggtgaaattgcacatggtaacatctctccaggaaatttagaccttggctcagctgggagatgttctacaaaaggatatttctgattctcattgattcgctagcaggttctcaaagggagatagcacaatattgtgggaggagacagttttataatctgacatcagacttgaagagaactatttcgaggccgggcgcagtggctcacgccagtaatccaggccctttgggaggccgagacgggcggatcacgaggtcgggagatcgagaccatcctggctaacacggttgaaaccccatctcagctgaaaatacaaaaaattaaccccgcatggtggcgggcgcctgtagtcccagctactcgggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaagacccaaatttcaagtgtatgaagtggggtctaaaatatctactacctgagggtgcagttataaagatcatataatgacaattgatcctatttgccttgtacttttccctaaaacaaagacatcatttaacttatttagtatagcttcatgtggtttcttttggtgtttctgttttttgtttgtttgttgttgcttgtttactttttgagacggagtctcactccgtcgcccacactggagtgcagtggtactatctcagctcatcgaaacctccacttcctggattcaagcgattctcccgcctcaacctcctgactaactgggattacaggtgcgggccaccacgcacggctcattctttttttttttttttttttttttttggtatttttagtagaagagacggggttttgccatgttggccaggctagtctcgaacttctgacctcaagtgatccacctgcttcgtccttccaaagttctgggattacaggcctgagccaccatgcctggcctcatgtgagcatttctaagaaacatttttctggtgacaaagaaaagaatagtaattttggcagagtatggtgcttactccagcattgacgttgcagagctccggctgttctgtaaagaaactaaactgagatggattgctaaaagaaaaaaaaaaaaggtggacaattgcaggtgcaggttagttgttttctaagtgtatataattcttttttttttttttttttttttttgagaagtctcgctccgtcgcccaggctggagtgcagtggcgggatctcggctcactgcaagctccgcctcccgggttcacaccattctcctgcctcagcctcccaagtagctgggactacaggcgcccgccactatgcccggctaattttttgtatttttagtagagacggggtttcaccgttttagccgggatggtctcaatctcctgacctcgtgatctgcccgcctcggcctcccaaagtgctggggttctttataattcttttcttttctttctttcttttttctttcttttttttttttttttgagacggaatcttgctctgttgcccaggctggagtgcagtcgcatgatcttggctcactgcaacctctgcctcccaggttcaagtaattctcctgcctcagcccccagtagttgggactacagctgcccaccacgcccaactaattttgtatttttagtagagacggggtttcaccatgttggccaggctggtctaggaactcctgacctcaagtgatcttcccgcctcggcctcccaaagtgctgggattacaggcgtaagccaccatgcccggcctaagtctatataatgtttgggcaggacacacagcctgtgaagagttggatgtgaaaaatagtcactgagaaaatgctgcctcaagaattatcctttacatttctagcttgaaatatagagtatttgctgctgtgaacttctgaaatagtgaaatacttcaggaggaaacatgttttgtggatgaaataaaggtctggttttgatatgaggggaagtaaagcaatcagatggatatgccaagtctgaaggtcagaataaagatctggcctggagatagaaatttgttaatggtcagcataaaaagggtgtttaagccctaaaaaacaaacaaacaaacaaacaaacaaacaaacaaacagcaaagaggatccatgactgagatctgaacaatgtaaacacctggagatatagtaaaagagccaacaaaatacatgccaagttcatattaaagttaatgggaaaagacaaactacttagtgagagggtttcagacaactagctattagctagctaatttgggaaaaaataaaatttataaagaatcctcgatcagatatccaaacgtaaaaagtaaaaaccactcacatgctagaagtaaatatataaaagtaaattatttttaatgccaatattatatagacaaaaaataattactctaaattaataaatatgttttctgtcaccgtcttgcttttcttctcaatttattcatgtgtcattttaactcaccatataatgactcctcttaatccaattattttttatttaacacttcatttgtttttaataagtgtgatatcatatttctcaatagaggagaaatgtagaatttggcctgttatatttgaaacacctttgcttttcagagttgggcttctggaatgtggttaattttagtattctcgtcaggcgtttatttttcagatttctgtgattgcttctccaaaataaccagtgtctgaaggtgatgactacaataaaattaaaattatgcacgccttcaagaaaattatgtataagtaaatttgaagcttttaaatttgaggcctattttaaacacactttcatctgagttttctattcacttttctcagaacctcaatcttttttcctttcagatcagatattacacctaagaatattgtaatattgagactcttatctgaagaaatagggactgcaggaaaactttcaatagttaaaatcattcgctgaagtctctacatgaaatttgtcagagcaaaattgtgacatagtcaagcattaatgtcttttactcactttctgcattccagatgtcttctttcctttccctgcacttagtgtctttagtttagacaactgaactaattttttaaatattaatttactgatgacattatatggtacactttcatgaggatggattttattgaagggtattccaatgcacgtgccagcactaaaaccaaagaaaaaaatcactgtggaagaatcccaaacagaagagatatttttaggctggcattcttagattcattcttcattttaactagtatttttaaactgtaaatgtatggaggaaatgaaagaaaaaaactagagaataacaaagagtacttcagcccagatgtctaattctcccttctgaaattgtccctaatacaagtttgtttaatttcttagaaatatatgttatattaaaatacatgcttttaggttaaaaatgattgtatactctatatgctatcgtgtacctaacttatttctcctaataatactttaatcaacaaagagcaactatgttctccttaatagccctaatggactatagcataccgttttctggatgtacaatactttacttaaaatttccttctttcataatgaacaattatgtcatttcaaggcttctgctataacaaacaataacacagtaagatcttgtacaggtatctttgtatgcatgggtgagtacgtttgaatgctttaatttttattttctttgatgtatggattcataaaattcctgagaactgctttattatgctttttactttttcaaataaatggggacttaaatcatttgcaactgacttccaacctaattgcatgaggtcaaagaactggtggtgtttaagttgacatttgttaagacttgcttacatgctagtatgcgactaaatgtaaaatagtagtagtaaagttttatttgtgcttgagaaaaatattctctctcaaattattgtatttggaaattgatatataactatcagaataaatttgtttatttactttttcaaaacttgttttttaatgatttttataaccttgacatcaatcttcaagaaatttttatagaattaatccttttttggttgtattgtctggcttctccagagtagcaataactatagtatgtatgtgcatgtgtatatgcatgtgtaactgcatatgtggacacatatacacaaggcttcactcgtgtatatgtgtgtgtacatatatatatatatattgagaaagagagagagagattataaaaaattggttcatgcagttatgaaggctgacaagttctcagatctacagttggcaaattggagacctaagggaactggtagcatagttctagtctgagttcaaaggcctgagaaccaggatggccaatggtgtggttccagtttgaaggctgggaacctcatgatccaagaagagccaaggttttagtttgaatctaaaggcataaaaacataggtgggaattcaaaaatgaaaacacttggacacaggaaggggaacatcacacaccggggcctgtcatggggtggcggggggtggtgggggagggatagcattaggtgatatacctaatgtaaatgacttgttaatgggtgcagcacaccaacatggctcatatgtgcatatgtaacaaacctgcacgttgtgcacatgtaccccagaacttaaagtataaagaaaaaacaaaacaaacaaaaaaaccagaaagttccaactcaaagacaggcagtgggaattcccctttatttcatccttgttgttctacctaagacttaaactgattgcataagcctcacccacatggtgagagcaatctgctttactctgtctatcaagtaaaatgttaatctcacccagaaataccctcacagatacaaaaggataatgtttgaccaaatgtctgggcatccaacggcccagtcaaactgacacataaaattaccagaagggtggattaaaaaaaaattatccctgaagttttatcatttttgagtgtatatatgtggttattttattaggtgcacacaaattttaagtaactatcttcttgctgaagaaagacttccgtgatggagctgccttctctatctttaaaaattattatttttttgtattaaagcctactttttataaaattaatataaacataccatcttttggttaatatttacctagtttatttctttctatccttttacttccagtccccatgtcttgatgcattagactgctctcttgtaaatattatttagctgaaatttaatgaatgagtacagaccatttacatttattaagattactgatattttgggacttatttctatcaactggcttttttgatatatacgctccatttatctcttaatagcggcaagcagactttcctccattttcatttttaattgtttcctttcaattatgatacttttcagaatattccaaagtatgaaaaattatattataaatactcatgtacaggtactacagatgttgaagaaatgagccacacaagaaagggcatgatatcagtaaacacactacctggcttcaaaatctagctttatgtgaaactgggcaagccatttaaactttctttgcccaagtctcctgatcctcaaaatcagccttgtaataatgctatctcctagattttattgttagaattaaatcaagtaatatttgtaaagcacgtacagccatgactgctacatactaaataagatatgtttattacatgtaatatagtaattaaatgttaacattttccgtatcagttcatttctcttagaaatcaaaaaagtaaataaatattatgggagtagtgaaagctgtacactacctccatccttttttccttttttctctccggaggtaatcattatcctgaagttagtgtgtatttctcccacatatatttttatacagtaaatatttacccagagaaaatatatagtattgctttggaggtatttaaagaatacataaacatttcataccataggtatccctttgaaatttactttttaaacttattattatacttttgaaattgcagatgcttatatttacagtatgtcattcattttaactactgtattacattccattatatgaaagaaaagctattttttcatacattctctccattgaaagagagttaaatttttccactaattttttcttagccccaaaactttttgtcctgtgttttcttacaaacatatgagagtttttttttaaagtgtatatcaagaaataaaatctcctggtaattttcctgtttccagatttaccaagcatggccaaactactctccgaagtgaccatgtcagttcacagcaacaatgcctgaaggctcgtgctttccccatacccttgtgtcaacacttgactatgttagatttttaaattttagtcaatatcatagctaaaaaatggcatttttattgtagttttaattttctttccatgtatttattgaccatgcagcttttttcctctgtgaagtgcctgtttatatccttcactcttgttctatattttagcctttatcttatagatttacatgtattattttatttcatactaactctttgtgctatagacatctcttttcagttagtgatatgattaacttattttttcatggtgtcttttgtcaagaagattttaattttagtacgtatactttaaaaaaatttttatttttaaggccttttaaaccttattaacaatatttttttgatattataaattattctctaatattttcttccagcaatttagcagctttgccttttacatgtatttttttaaatcatctgcaatttactcttgtgaatactgtgatataaggatttatttttatctgtcattaaaaaaatgtgtttagtccactgtgccttcaatttttttctcaggatattatttaatagtccattatttcagtattgtttagactgtaacttttgccattatatgtgtatttatttctggattgtttattatgttctagttgcaatagtttattctatactatgttgtttagaaatagctctatagaagtgttcactgttaggcagattgtgcccccttttcgttcattctcttcaacaccatcttggtccccttctttctctaaatgtggctgaattagccttagctcttttcaatttctgatttaggatcagcttgtcagtgttcctgaagcatcttgctgtaatgtttattattactgcctaaatttatataataatttagagagagatgttttattatgtacatatttttaacagttgcctggtatacctctttatgtatataggctttcatttattatgtctgttaataaaatttaataattttacttgaaagtgttatttatttgttgctacattcatttttatatggctggtaattttgttcttgtaaactgtataaattaaaaggggcattttcaaattaattcttgatcatacaaataaaattataatcaatatttcttaatgttccacttcactaaactcttatttgtactgataaactatgttttcttttgatttgtctatgtaaccaattatgtcatattttctgcaaataatgtattttatctttcctatgttacaatattatattttatgtcacattatatttattaggatctcccaaataatgttaaatagaagtgttgatattgggagtctttgttttattccagattttcaataaaatggtcttaaagatttatcattaaggtgtggtatttaaagtgaatttttgataaatttgttatttggttaaagaaggtctcatctagtcctagattgctaaggatttttgtttgacttgatttaaactcaaatagatattaaattttttcaagagcttttttcctgcatggggtgagaggacaacataactttttctttattctatttaatgtaataaaatacagatttttctaaagtttgctaatcctaaaaccatactccatcattgtgtgtgcagggaggcaccttctaatagtacaatgagtattttgtttattttatgtattgctgcatttagtttgacgctgatatgttttagatactgattctgattcacgaaaggttctatgtgtgattttcctatttctcactgagttagttttggtaagtagtttttctgaaagctgttcatttcaacaaaattacaatttatcagcattacttggccatagtatatgtttagatgtaaaaaaaaaaaaacttgtattttttgtcattccttaatttcttttgtcttttatctttctttttcttctgtgggtttgcttgagaagcatctattttattcatcttttcgaagaagcatcttttggttctcttggccctttctgttctgtttccattctggtaatttcagttccactatgcagtatcttctttctcctgctttctttgagtttactctctttttattttcataatttttttttaagaatggggaaataggtagtgaattttcagtccatttttcttttaaaaatattcacttaaagccttaaaattgatttgtattacaccttattaggatagcataagtttaaataaagtgcttattttgtctttatctctattttccagtttccttaagacattcaaattgcatatatgttatatatttttaaaatatcttttttaaatttagattatactgtacgtctagagtaggactgttttttaaatatttcatgtttccttacaagattatgggttttctaatggtttattttcaattatatggtttaaaactgtgtttttacaaatattttccttatgcatctatcaatcactaggagagatttgttaaactttccactttgaagctatatttataacttttctgaatagtactgtaaattcacttaaatatattttgagtctattattatatgacttttcttaagtaataaagactctattcttgaaagaagcattttgcattaaaaatattttgtctaatattattattcaaggtagtggagactacctccttttctacaatgtatacacatttatatatatacatgtatattgattttttaatatttgtgtttcattatggtttagctatattttgtagttatttctgtctgtaactttaggcttctttttcctctccctccttgctttctgtttactagtttggtgcaaaagtaattgcggtttttgccattgaaagtgatggtaagaaccgcaataacttttgcaccaagctaataaagctttcttaatcctttattttctctgcttatttaaataatgtttattctatgtccatatatttagtgacttcacctaatttgtaaaatagctccaaatgacacaaggcctcagaatcatttaattgtgattatgccttctaatcaaattgtttagaattttagctgcaccttataaatatatattgctgaattattcattgttagtgttattacttacttggttaggttactagcttaggtttatctacttctttatcaatttcttcactcaccttacttcttgcatttttccttttgtgtgaaatagcttccttcttaaaacatatttttaagaaattatttcagcaaaaaaactgtatgtactatgtcctttaaagtatggtatatcataaaacatctttatttcacactcactcttgaataattttttttaatttcattgttttacctcatcactttaaaaatatttgactccttatatctgattgttacttctgagaaatttcttgtcagtgtaaatgtcatttattataggacatttgtcatttagttctagttgcttttaagataatttatttatgtttagtatctatttagggtttttgattgtttgtttttgatgagaacaatagagatccactctcttaacaagtttcaaataagacagtacagtattggtaaccatagtcaccataggggaatgtttgcatgggctaccagtgaagtttcaggtgtcaagtcttgcagtatattataaatttgcttttccagatgtcttagatcagtgattgtatagcttaccactcccagcatttaaattttttttcaaaaaatcaatagctagttcctgcaaatgtggaacgtttgcactctgcctgatgtctgcaaatgtgtattaccatgcactcaattcgaatgttctctatcacacctattatctaattttcaccactgctggcagccttatctcatagcctgtgactaaggatcagtgcaggggcaagcagtggctttcctagcactccctatctaatgtatcacatataaaataagtgaaaacagtgtacttactctgcaaatactgctctaagacatactccttagcatcttatgtatgttcatttaagtttaacccttacagattttccaatgacactgtccagacttattctctacttctgttgaaaaattattttatttcttttttgttaattcttattctgcctgtgtttattctttattttttaaagagaagaacaagatacaagattgaaatatatttataaaatgtttacatagaagtaaccctctaagtcacttaagatgtgtgtgtgtataaatttttgatttgttagtttctttttattattttgccactaagtcaataagtaacacttgagttctttttcattaattaacaaaaataatgcgtgagtatggggtgtgtgacagttaaaaatcaaaacaagctacttttgtcataagattatcaatttaattttgtgaaattagagatactttttgaatatctttaattcaatgtaaagtcatctaactgcttttaaattcaattaagtaactttttgtttcttaatagtcctatatattgcttgttgtcattttctcagagaaaattagtaacacaatatcagcttcaccaattcaaacttttcaatttgttacctttgtttgatctgaaaatcttagctcattttattggtagactttactgcctttatttcaactaagttctttaaaatttcaaaacagagtggtttagtaagttaattatcaccttgttctctggtagaactactcctactcagttacggtgctggagatgatagcttttcatggtcttaagttttaaatcaaagagaaactaagccaaattgaactatccactgctttcccttgaccacctgacattatgatccaatcagtaacacttcaaagtcagtattttaggttaaaaaacaaacaacaacaacaacaaaaaaaaaccaaggagccacagaaagctaaagataactgaaagcttgtcatcatcatcaactctgttactgtattattccattaaaccagaaagccaaacttatgctacacaggaagtgcaaatagaagtggatctctattatccatatgttgtttgcagtttctgggttcaactgaaccaaccagacccaccttgcaccctgtggcataacctgatcatgttcctgtagcttcttaaatatggttcattttttctttgtatggctttatttctttagtgatttctagatagtcttattgactgccagcccctattcactctcagcctctcagtttattatttctagaatccactctttttttgttttgaaactatatattttaggaaagacacctgtggctggcatctccttttgttttattctggcaataaggttgatgttgggacatcaatcgcctgtctttagaatcatatataacctatgatttagaacgaggttgtcatcaaaaatttgcaaacatttgcatatatcttcattcaccatctcttcccactctgctaattcactttcttgtcttctaaatgcttttgcaattgaacattgccagccacaacccctttctaggaaaatgttctttttcaacaatatagacgagattgcttttctaactgcagtcattgatctaatcagaacttcataaatctttaataaattccaacttaatgcattactgaggtaccatcgaaattatttcaattattgtcaaaataaatcttggggtggggatgggaaaaggggtgcttttccaaagagtaccattagtttgtttcagtttttaaaaagcatttttgagggtggcagaagggaataactgaaacttcagtgagctggaataaagcaagccaacattactttaacctataagatctcctgaaaaacatgtacactgagtttaaactatagtatcacttcacaaaattcctctttaataatacagtttttttttttctaaagaagaacaccctttagtcagatgggttatgtattctacaattggctttagagactggtgatttttcactagcagttacagtaactagagaagaattactgcttccttaactttgtggctgtctgtcgacggaaaaaaaatagcttaaaaaaatcaaagccagatggctctagaggaaatgcctctaatgcttcagctgttgttaagacaccccagggggaacacttttatggctggtcaccatggccctgctttcctggcccatctgctccctagatcttgtgtaagaccagtcatggcctctgttaactttaactgagcagcaaggtaccttgttctggctccatagtgcccacttaaaaacaaaacaaagcaaaaaacaaacacagacaatgcaattttttgaatatcctcaaataaggcctcagctaaaacagaagagagaaatttgagaccaactgatacacgatttttaaatcagcagaactgtcttctatttttttacaagtagtgaccagttggcagtgagaaacctagaaaacttgtgaaaattaattttcttccccaagaacctgccataaatcatcctttataattttactcaagtggcatgagagtgatggtctgtatatcatccacaaatttcttcattgcaatgaggttaaaagatagtgttattaagaataatggttaatactatacttgcatgttaactaaaaatttaaagtttaaaatgcagtttattttaccaagaaatggatacccattattccaactgtattcatctggatgtgtttgagaattaaatacataatgtctggaacacaatatacagtcatagtttattttccctgtcttgtagaaaggcaatccacaacattttgaagagttgtgtcattgatccatgggtatttaagtgaaataggtgaaactaatatctatcttgagtagctcttactcttgctagaagcaatgtcaaagatgcagtaacgccaacaaaattttatgaatctcttcatcactagtaaactatggcagagctttaaattactatgactcctaggagggcttctaatttgggattcttggagcctagatttctgttcttcctacaaattacagattcaattatttggtaagaagtcatctatttactggcaatgtgtgctgaatggttgtgtaaagtaaaactaataaaccttctaagatgaaaagtattagaaaaaaaagattgtcaaaagagtctgtttttaacaatggtaatagaaactagcatgtacatatgttgaagccaataacatacagaatctctttatggtttcacaggaaaaggtggcaacccaacctcagcatgatagcaattatgtataaagaataatgcagtctcaacttcagtgtgatagagtttatatttttaggtacagtgtgatttttaactttgttgggttggtaattaaaattaaggtaggtgcatgaataattcatgatgaattaaaatgtctcacatagaaaaatgacactactagtcagttatttaggaattacaaaatttgttctcttctgtcagatattcattacttctaatgaaaagtgttaaagagcccactttttaaagcaaacgtaaatctgtctctggaaatattttggtgtgattggaactcattgattcatttactcccagaggcttctagcggagggatcattattgaagcacaggttgaaatataatcctgagaactttatttatgtcaacattaagaagaattttgtggccgcagtggttcatgcctgtaatcccagcactttgggaggccgaggcgagcagatcacgaggtcaagagatccagaccatcctggcaaacatggtcaaaccctatctctactaaaaatacaaaaattagctgggtgtggtggtgcatgcctgtagtcccagctactcgggaggctgaggcaggagaatcgcttgaacacgggaggtggagttttcagtgagccgagatcgcaccactgcactccagcctggcgacacagcaagactcggtcttaaaaaaaaaataaaaaggaattttggaaaatatttgtatttatttcaatatccattaatgaattttaacttaaggtaatttcatatttatttataacattaaagggtcttcgggttaaattttaaatcttgaatacagtgaatttaagaatttagagtaagaacagatatatttaaggtaataattttggttgaaatatctaatttaagacagaagatatgctgtcttatcatataaagttaccttgtgaaagatcataggcaaatccaggactctgcccttgtgccctgattgtaccttctgggccttccttcaaatcctaactgcctaactgcaattcaagtttgagtggggcgcgtttcttgccataaccaatgaaagcctaactgcaaccacaataaaacattaatcatataatcttattcagtgtccttgtaccatactatgctactaatcctgctaagtgtagtttagtgtctgaaatcctcttgaatgaggcctttgttaataattttccgtggtgacttacttgatgtgggaaacatattcctcttatttgcgatatttagttctgtaaatctatgatgtgttgattaattcctggctctttcactacaatgaactatgcataccatctaaacaaaattagtaaaatctccaaaatgttctcttgcctgtatatcatatattaccatttcaagaacactaagtctatttattaaaatgaggctataacagcaatactattaaatataacattttaattttctagttcattattaaaaggagccctaaaaaggttcaaaacagattaagttccaatgcatacctttattaaaataggaagaaatttttgaatcagaagatgaattaatgtcaaaatttgtcatatggaatgtgtatgatattgtatattaatgcttttataactgtttttggtaactggaatataaaattccccacaaataaacaataaattaattgtgacaaaaggaaaaacttaacatatcaaattaccttgtacttaaccaaaaataatctctactgattatgtaaatcaactttaacatttaatatttatttgaattataatattagaaaacaaattagccatgcggtgtgtgtttaagtgtgtatgtgtttgcgagagggtatttcttctcataaaatgggttatgttacaaaataatttcaaatcagttatttataaaaaccttctatattttcccataataataatatcacacgtactagaaagatacataacaatctttataattgtaaggtccaagattaacaaaccttgacagccaaaacataattcactttgactttaaaataagtaggaagatggttagaagagtggaggaaaacggtcaatgaaagtgagaaaaagacctggcaactaaacacctctaaaatcaaaagtaatggaaaagctgtccgggtgtggatttcctttttttttttttttttttgagacggagtctcgctctgtcgcccaggctggagtgcagtggcgccatctcagctcactgcaagctccgcctcccaggttctcgccattctcctgcctcagcctccggggtagctgggactataggcgcaggccaccacacccggctaatttttgtatatttttagtagatacccgggtgtggatttctagaagaaaggaaacatgtacaagtcacttgtaatctcattgtccacagaataaaaaccgcctaacagctcattatttaaaattaaaagtcctgttgtttagcaaatatccacactttccatagcagaattgtgcttttctgctccttgcttctgggtagggggcaatgggatgttcacacatgggaaacaaggaaggtcttgaaacgtgtttggcaattgaacttaccctcttgccttcctgcttttctttaccagaagaaaataagttagctgtaggatttaggagaacacattgaagaagactgagacaaaactaagcctaactaagcttagaagagttaaaaaacaaaacaaaacaaaacaaaacagtttatctggaactacgaaggcaaaaaaaaaaaatacatgcttactctaaaatgccaccaagttttggtatgagtgattatgcagcagtattgatacactaactgatatactctttaaaggaaacaattagttttgccaaagaaacatttagtacagaaagtgttagactaagcctatacaggaaaattaaatgtaatattaacaagaacagtaaagataaccttggtagcaattataattaaaacagaagtgttttacttgcattatctcattttatataaaagacacaattcacattgtaaattggaatgcttacaattttagctttactaattaaaaaaacgtatttctatataaattgggtcttatattttccactcaaatcagtttagccatctcttgtcctagtatgataaaatttggtttcctgaatgaaatagcagtaacaacaaatatagatctccttgtcactgatgctatttatgactttcttatcaaagttagtgcctttattattttggttgggcagtccttagctttttaaacaggcaaatatttatccttaaagaacatctatccttgcctcgtccttttgctagcatataacctgaagcaggagagacagagagagagaaaaacggagagagagagttttcaaaaataagagactatttctgcatcttaaaagacagtaaaatttaccggtgagcttgagggaagagttctacgtcaattctaagcagagaaaagagaatgttcagaactatgagatattgtggcccactggaaaacagataaaaaggtggtaagatttgagaataaattcaagcataggtggaccaaggaaaggagtgtgaaggtcactggtcattaaaaatttgggttgaaatgcagaataattaccttgaagttagacatttgttattcaatgaatttgtagtttttaggaaggaaagtaaaatttgtttttttctgtttttaaaagcaaaactcatgtgttagtgtgaaaaaaaagatagtagtgcgaagaactcaaagaccagttaggagtggagagagacacctgttaagaaaacaagagatgttatattatttcaggtgatacatgcacttttgaactcaagcagaggctgtgaggatgaaaaagagggataaatctgagacatctcaaaaggcaatggaaattccaatactttatagcttcaaggcttagcctgctcccttttctttggcctccactccaactttaatttccagacccagattcctgccctgtgtatgtgatccttcaccacatgaataaaagaagaaaaatgtggtaatcgaatctgacaggaactaaagttaattttttattttatgaacaatgccaatgtagtcctggttccactataccttatttaattgacaaattatttttaagagggttgacattctaatcattgatcagcaaacagatgccaattacaagtgaattcgatcctttcattagcataagcgcgaaaggagatctacttgaaaatacttagttgattcattattgagtatgtttaagaaaattaattgcatatttagaatatgtaaaactgacttaatgcagcctgttttctattttaattcagactgcttcttaacctaattttttaatattgaaaataatgcaatatgtaaagttacattatcattcaccagttaaaaggaatggaagctatatctcagaaagaaaagtactacatcctaccaagtatagttcagagagtgctttcttcttgcattgttaatcagatgcaaatatgtattggaattgttgatacattcatcttcataatgtcttttcagcttgttaaagtgaagtttaagaagctcctggaggagtaataggctgcatataatggactggggagtgaaaacttcggttctatatgcttaattagtttctaatttctctgtaatctcctcatgagactctaacagaaaataatattgaccatacatatggtacaagtgggtgctggtattttggatcattctcaacgggctcactaaattatttactaagcctaatgtattactaattcaaattaaactccacctcccatgtaattgtaaattcaatgagtaaatagtgccctgtgaacatcatgggcttatcattagagataagtgaatgaagtgcctctcacaatgtctgtaaggaaataatgtaacaccttaccctgctgcattaaaagaataagagtttacatcatatttttaaatttttaaaatgctttgtaccctaaggtaaacaacaatgacagaaagaataacagactcattctgtctagttcaagtccacaaattaagtcaaaccttgagactttgtggtaagtcactgactccctaacaaaaataagtttatcctgacctctgaaattttgatgtgtagaaattggagaatatcttctaatttgataataattcaaagcagttattaattttccaccataaacattacaaatttgataaattaaatttatttctagtctattttcatttatttatttttttttttcttgagatggagtctcgctctgtcacccaggctggagtacagaggcacgatcttggctcactgcaagctccacctcctgggttcacgccattctcctgcctcagcctcctgagtagctgggactccaggcgcccgccaccatgcccagccaatttttttttgtattactagtagagacagggtttcaccgtgttagccaggatggtctcaacctcctgaccttgtgttcctcccatcttggcctcccaaagtcctgggattacaggcgtgagccaccgcacccagcctcacttatttaattttaggagcaagttatgttaaaacctgtattccaatgaaaatttttctgcaaatggatttattttttttctaagtgatttcatctctgactctacgtttgacgcctgatttccagtgagtgctcaataaaatcttttatattactgttattattatggcagtcattttcatagtgtataaatatatagagattcaaatatatactctatgataaactttcaagctgcaagtattctggtggctttagcagagttaggagacattaaacaaacaatttacttcaatttttcttgttatataaagcagtgatgcatgtttcctccaaggttcaactgagcatagtattccatgactactctgtgagggaataatgtgatcacacgaaaccaaacccagctgaaacactggggaaagattaattttgtatacatggttatcattccatatttattcaccaagtgccatctggataagaagcataagatatgtcaaccaggcataatcgactgactctatagcagagactaactattcccaatatataatcccttcttgtctggacacactgttctagatacactaaccaccttaaatactttgatgattctagacactcggtcagctaatccagaccagggtaccagtccatgtcctgttaggaaccagtcacccctcatagctcgtattaccacctgagctccgcctcctgtcagattctcaaaccccattgtgaactgcacatgcaagggatctaggttgtgcactccttatgagaatctaatacccgatgatctgtcactgtctcctgtcacccctagatgggaccatctagttgcaggaaaacaagctaagggctcccactgattttccattatggtgagttatataattatttcattatatattacaatgtaacaataatagaaacacagtacacaataaatgtaatgtactcgaatcatcttgaaaccatccccacaccacccctgattggtggaaaatttttcttccacaaaaccagtccctggtgtcaaaaagtttgggaactgctgccccagaacaaccactccagataagacacaaatactgagttatatgagtgacgtgagaaattaaaatttctaaaaacatgaaccaatctggacaaaaagactatctcctcaacatcccaggagaactcggcctgccttacattcttacagggataaaggggcatggccaagtagagatgtcaaataatctctaagtgggccattcactctcttttacgtgtataaaatgtgtacattttctcaaggtttagttgggcgtggtttcacataatcaatcccgatgagtactcaagcaccctctgacctgttgaaaactatgcctgttaacttatcaatgctgttgctgattaatgaagaataagtaataattatttataaaattttaatgcatgtcttagtgcttgtttatttaatcttttaaaaattcagttagctaatgtttataatgtgtgctattaatgtgtcccctctttggaacaccttacagaggaaactgaaagtaggaatgcctttactactaagtcttttataaagataaactcggacagaaactatttttactttctaaagcttatacgtagtaaaataatatgctatactgctaacaattttattattgaactaattaagtgtcatatctgaaatgaatgaggttagttgcaatgaactttttgaataaacaaaatccattaatattttagtatgaattattaagggttgctagaatgatgtatgctatactgagttctaccaattttctaaatattacagttagtcttattcattcctcagtctgttcaacagtttttttgagcatgtattgcacatttggaaattagagatcaacaagttgatgtacaatatatgaaaattatcttatctgacataaagaatgtaatctgtttctaaaaataagccacactgaagggtgaaatacacgcattctatttatttactattattattattattattattattattattattattttggagacaaagtcttgctctgtaccccaggctgaagtgcagtggtaccatcttggttcactgcaacctccatctcccgggttcaagcgtttctcctgcctcagcctctggagtagctgggaccataggcacgtgccaccacgcccggttaatttttgtatttttagctgtggtacatgcctgttatcccagcactttgggaggctgagacaagcatgttatgaaagcatagttttaattgctctttaaagtctaaactctctttaaattgtcattcattcaaattttttaataatctaacacataatttttatcctagtttccattgttttctacattgctgtgcaattaaatatttcattccaaaatctactcaatattttatattcctcgacattattttcttcatgccagaggaagtaaagttacttaaggaaaaggtgcagaagatcacagaggaagtggaacatgagctgagccctgaaaagagaatggaactccaaccagttgtggaagggtcttgactgtcaggcaaaggaacttagagctgatctgatggtcacctcataacctccatattctctttttgtcttactttcttttgtgaaagtcttttcttagtttccaagtgtggagacttcacttactttgattcagaggttatcaggaaatttaaaaaagtttcaatccagcagttcatagattaaaaaatgaacaagaaaacagcaaggactgttttttcttttttcccactttcataaagctaagtgaaacacatcaactttaagaaattctcctctttcttaggccaaaattaagctctaaagtttagaggcaagtagaaaatcaagcataacttcccctcttgctacaaacaaaagaaaacaaaccttgcagccaggacagcaggaatctggcttggtaaaactgcaatcaaagctgctctgtagatcagccagcaatgaatctcaagtggtaatatgggagcatgccaccaccatgatgctttcaatcctagttagcaaatacccccttctaagataaaatctgtctcctatgagtaaccatcagggccataaggttgacaaacccaaacgaaagcatcttttgttatccaaatgccattataaatcacattttgtaaacaaatgttgcttaatattactcctactttttaaccaaatacaaaaagttttataggttcaaaagttatgtgtgttctgagatatgtatactaatgtaaaatgcatcatgatatgctattcatcttttcaaaggtaaaatgaatatataattacataaccataagttaatctttcagagatatacagagaaatagagacatgcaactaagcctgtgaaaaatataaagaaatgacaaaaatgtgaagaaaaatcagactgtagcaatataataagggtcatagttgttttccttttcttttgtctttgtaaaaactgaataatttaattgtcaagtacctgaaaatttgatactaattcccttaattacatggtactaaaaattttcttccaaggtttccatagcatttagtttagccaaaagtaaccttagctgaggcaaatagttttaagtgaaaatttatttatcaaatactactttggaattttaggaaaggttttttttaaattataatatggttactttgatcacatttaaaaattagtggaaattttgaataatgacaattcctgtgaaagaagcaaacagcttagtatatattatatccaaagtgctattagctttcttctccctctaaaagaaataaatttcaatcatgatgaagaattgttaaatatactcttaagcaagtacaaaaataattaaggaaaatggttagatttccatatttcagagaaatgtattagttttataatctgtataggagactatataatcaatataggagactcactgaaaaagtggtctttagggtttttacctttccttttatgtgatggagtttaaaaaagatgaaaggcaagcttttgtgtttacatctggagtataaaagcgcctcagtatgagagaaggacattccatgaaatactatgtcagaaacattctcagtcagaattccagaaatagcaagatgttaaatagataattaaaatgtcttcaaggtttaaaccatagggacttaggtttttaatcatgtagtgtatattcatcagaagtttttacttttatcttgatcagattttgatgctgtctttgggggaagaaagaccatggtctgtacttctgaaattctttagtttgataggatctgatattagcaggctcaactcaaaatagctatcattttattagatggctggcagaagccttcagcaatggctgtcttgcaaaaacaatgggcttctccatttctgatgaaataggaaagctgtgggaacttctgtgtcatggcataggaattgtgttacccatggtgtaagattttttcttttcagggaaggaatcaaacagaaggatgtaactaatcacaaccttaatgtaaacagacttcattccaaatatatatttttttaatttaatgcaaatataagagtatacatttggcagcaaggtgcttattcaatcaaaaagcaaatatctaaatatgtctttgatgatatacattatcaaagatgtgcagcttagaaactcacccatttctatctcctggcatatgtggcattgtttttttctacttcattctctattttgaaaaaggcaccgcaaagtatacttcataatggtggacattaaaattaaaacaagaaaattatcatacatcaacctattgttagtttcatattaaaatatgtgttgcctaaagttagatttaagacttaatttgaaatatagatgcatatacctttaatactgacaacagtcataacgtcattagatatttttctatactaattctcatatcagtcttctatcacattatgcaaaagtgagttgaaattattgtatttcttaatatttgagatttaaaaatgagatacttctctaagtcatagtgaatgacaacattgcaaataataattaaattttccttagtattattgctaatgaaaagggaacaaaaatcattatagaacaagatgtttcaggtaattgatccatctaaaatcgctccgtattttacatagaataaattaacttacctttcttgttacattggataagaaaaagagaggaattgataaagaaatatatcaatgaaaatgttcttattcatagtgagttttaagcagtaaaatttcagattctgtttacattttagtttaattgcttgaatatacatgtaggtggagaaaatactaattgtgcatgttagactggatgattgtttggtagaaaagcaaaatgtcctttacttgtaaagacaatttgtagcataatatcagttaaatgaggacaatatgattgaggcttttaaaacataattcataactggaaactgatttttttaaatttaataataagaggtcaaatataaaactttctaaaagcatcattttatagtatgtatatggatatatagtatataagttcatactatttaaatatataccacaaaaatatagtataggtagaattgacttttgataagatttagtttatctcaaactcgtaacaatgtctaagtacactaagcaactgagttttctattgacattatttcaggtctagtttctaatcttatcaataatggagctgaggcagagtaaaatttagacttctttcataaacattattaaaactgaggttcacaccaaaatcatctggttataaaggaggatttaaatggatggtataatttttaaatatgtgaaacaaaaatcaaatttactataggcacagaggcatggctgcctcgtcctttattctgtaaacatcgagtcttcaaattccatctatatcagcaaatggtcagtttatctctttccattcaaaattcctaaattgttttcagctcttttacaaaatctctctcagtatgaagtcttgtctggattttttttaaaaaaagttttggatttaatttggggatcttttagaaaaacaataacgtgaggttttaactgaaggagaagtttgaattaaatattctaatttaaagtaagttaaaataaatatgttattgtgtttcaattccattgaattattggtctcagatgttccagagtacaaaacgtatttcaggcctgaggctatttttacacacacacacacacacacacacacacacacacacacacacacacttaaaacattcagttgaataaaataacattgaaaagacttttcatattataggccagatagcttatctaaattttcctctatttaaaataattaattactgaattaaacttcatattttagcaaaatgtcatttatatataaataaatcataaaatatacttttcatgaagttttattgaaataaaataattctgtcatagcaattacctataatttcaaatatattatattttagttaatgttaatgaaaagtaaaattaggttgttacccatcaactcttttaactcaaatcaggaattttaaataactaagcttgaatattttaagcacaaactcattcatatcaatcagacataatttttattttgcctttttgagaaatgatctaaataatcatttaggaaagaagattataattaaaacagtatgcaatttaatgttaatcagaaattatatgatgtacagtatcaggtaaaaatattcaaatgtcttccaaataacagaagtaaaactgagaacagtcttttaataaaggctattttgcctggtaggaaaagattgttagttgtaaaaagaaaccttttaaactaatatgatgaggtacatgtaaaaattaatattatgctctgatgttctctctagtgagtagcctaggttgatttattcatttaggtaattgtgttcagcaatattagtaattcactgttaaattgaatttggagaacgaacaataaattgaaactgcagtgatatttctttcttactgtgtaacaaacagatgtattgatgtaagttctgagtgtactacataagttaaattccctagactgtaatttgatcaaaaggctttagacatttacttgagctatattaggcggctgccattggatggcagtaaaattctacatcaatcactttaagcaaagtgaagctgggaaaataatgggacttttcttttattatttaacagcagaatgctgatttaaaaggcaaagctcagggggttgcatatattgtggcaataccaactaatttttttttaactgttttgttttcttctctgctctatttaaagggagatgcaattttagaaaaataatgcatagtattttgtcacagcaagagatgtttttgcttttcttttatgtaataaaaattttcatttttttatttttaaaaataagtcaataaagggatattaacaaattatatatgatttaaacctttgcacagtattaatgcctaagtcttctttttgttttcttctgattgtaaagcccatgtgcattttgttccgggtttaaaggctgatttatataaagagctgtaaatattataatgtctaattttattgaaacaatttgaatagagaacaaaaatatgaaatcacacaggaaatgttgctaacgatgatattgcagaagagagtgttccttctcaggaggccttaaattctgtgcttgtacaccactgaaagtagtcagtattttgcccctgagatatgaaagacaatattgaatatttctgatcttatgttaatttatggttactcacgaacgattcacagggaggtacagtctgaaagaaaatctttgtcatcttaaacctgttgtgtttatcacacaaaactaacaggaataaatagcacagagaacaaataaaatgagatatgtcctaaatgctatctcacataaggaaatatatgttcttatgtctcttctcactcatttagaattttatttggttagaagttggtaacatcaattacaatttatttggcaataaaacgaaccaattgttttcagaaaatattcaggatggtctgacacaatctgagggcgattaatcaggatttcctgggatcaaaccacagacttttctgctatttatcttttccctcactttatgtttaaagtctattaaaagtttatagtcttccaaagatcatattaggcattaaaattcaggcatctcattcctgccgcaaagattgttagaagaaaagaaaataaatgggttatcatgaatccattctcatcatgaagagtgtaaaaagcatgcacagtggaacaatattcatttatttttacgacaatgctcgagaagagaaaaaaaggaagtgaaataaacttagagatatgtagtattattacttccaggcacagggagttagaaaggctggaatgaaatgccttagtatgcagaaaagggcatatttaactgtgtgtgtgtgtgtgtgttgtaggatgccattttttcaggctttggtttattcagttactgaacatttctgatgcaaaaatttgatttaacatctatttaactatttgacagtatttttaaaagtttattttattgaatttttatgagaataaagaatacatttgcatggttttttacacttgccgttccccaacataacctagtggaaatatacatatgtatataagcgaacctcaaatatttatacctacagagttttaaaagaaaaatataatcaattaaatatttaaaatttagatattttgcatttgtatgcagggtcaaaacaaaagcagttcttccaatgaattacaaaattgactgatgctctagtctcaatcctagtttggttaattatatctatgcattcaaaaaaataagctgtttttacataaaatgtaagaaaacctttgcaaatacgtaacttcatttctttatattgagatgctgtatatccaaatgtaactgattattttccttaatttaaaaaatagcgatatggtaaaatttattctcaataagcagggcgtgctgcaaatactgtgttaaatttaatggtaaaaattatttaaagcacccattttctcatccataactgtcataggaaatttactacagacctctgaagaaattatgtggctttatccagtttacctgtataaatatagctttttatattaaatgttacaaacgaatgcacaaaataggatagcttagcatctatgatatctgttttagcactcacagtatgctttatactcttctgatgcatattcatttagtgttattaagcctgtacttaagcatagtattaaatgctcacactttggagctgaaatttctggatttgaatattggtcctgaaaatgagtaactgtgtgaccttggggagtgtacataatctctctgtttcatcacacagacacttataaggcaatgtagtaaattaagtgattaagctgtgctttggctagaatagagcaggtggaagaagacactcaactcagtctagcctacaggctgcacatctgcaggaggttgggcaatagagaagcaattccatgaagggcatacctttaactgggtcttcaagaagaataggagtcagccatgggaggaggaatatgagaactataagcaggaggatcaacctgtgcaaaggtataaaacacaagaaaatgtttgtaattctttcatggcataggcatgagatacatgtgaaaattgaaacatgatccttgccctcaaagagatttaaatttatcaaaaagaaccaaataagagtacctttcctatatactatcttatgctgtagtagaatctgacttctgtcatttgattcaacatgcagattatccagtgaggaaaataggtctgggcttttataatagattatatctatattttaaatctggaagcacagaaaataaaaaaacaaataattagtccaattcttacagctagaaaaatgagcatgtctggattaaaaatcatcctctaatgcaaataatacatcaatagtgctacactggagtcaccatattttcaatagaaatgtagaattttaaaaataatgaaaagagataaaatttatatgaaagattttaccaacaggctataaaattggtggagattaggccaaaatggtagattgcatagaaatcttccaattaaaaaaaaactgtaaacattataacaccaaagatataaaccagaaattatgagtaattttataagatagcaaatagttggaattgggttaatagaaaaaccagaactgaacaaattatataatgaacataagcaagaaaaagcttataagaaggcaaaatgcatttttttattttagttgaaggaatttgctatttaaattagaaactcattagaaaataagaacaggtaatctaaaatcacccaccatttgagggaaaataatgccatgaaataaagggacccaacaagtaaatataagaaatagctaccaaagaacagacttaaaagggaaaatagaaaactaaaataaatacaagcaatgactgcagatagaggcggtatgataaagtattcattaacaataacaagaataaactgtgataagaagaaactgatcattaaaatataaaatttatgtaaaaataaccaaattattaatatcaaagatgaagatacaattagtgagctgaaagactgtgctaaggaattaagagccattaccccacagaatgtttctgtgatattcaaatttcatagaacttaccattttggcttgtgtttatgtagtaaaaatgtatttcacctatccaaaacatttttaacaaagtaatttgcggaaagattttgagttacaattcagtagttcctgagactcctatagagatttttaaagcacacaaactgtcaacaaagagaatgagtatattggtaattttggacgattagaaaagttactaaaagttgattttctttaccaggttcacatttttatgtagaacattccttaaggcaatagaatcttgatattaaaatggaagatatagctcaacaggcagcacaaaatgacaaagagataaatgaagacatgggtggtacattgagaagacctactatccattgaaagtgcattccaaaagacaagaacacgcaaatgagacgaggaaatgcttcagagttgaagacatatcttcacactgaaacgtctatcaagacacgataaaaaaccagacaagtagacttagtgtggtgaaatctcaaaacaaagaagataatgatacaattataataaaaaatgctagcagagaaaaacaagcaagcaattaaacactcattcacacacacacagagagagacacacacacaatcacacccctcagattatctacaaacaagcaagaatcaaagtggcaacagattttcccttagcaaaacagattttagaaaacaatgaagcaataccttcaaagttctgaaagaaaatgattttaacttttctttccatatctatctatgtttatattatctatatctatatatttctctccctctcttgatgtctacacacacacacaaactttgtatctctttgaatctacacacactttgtagctatacacatatatgtgtctatgtatatgtatgtgtgtgacatatatatatatatgtatgtgtgtgtgtcaattaaagtagtttttgaaatgcaacctgtggcagactgtattttcataaaaagtccagagcaatatttctggtaccacattgtctgcagaacatcagcactccctatcaagagatggatgtctattccccatgtctttaaacatagagagactttttgactgccgtgataaacagagtggacagaggcaacacttgttcacatttattatacaaaacttttaaaatgctggatgataaaagaaaccatcaacaaaaaagcaacaaatttgtagaaaatacttcaaacatacatgagacaaaaaattaccatgaataacatttctgaaataccttaaaaattagtagaaaaattacaaccataatttcaaaaatggaaaaattcaagaatgatcatgttacagaagaaatacatatgggcaatggaatacaaaaaatatgaaatacaaaaaaaaatcaaaaaatgaaatacaaaaatatgaagatgaaaattgaaatggcagtgaggtgtcactttggcttatgatactggcaaaaatatttttcagatttgcaatgtctagtgttagtaagagtttagtatacaaaagactgttacacatgattgattttgtgaacagcaactgatagtctctaattaaacattaaaaggtgtaaatttcttaacgtgagttctatttgtaaaaatttattatacagaaatatttctgtgtgtgtacacatctacacaagaaagtttattagagcagtattgatgacctccggagttaaaaataacctaaatactcattcttaacttctggcatatacataatacaaagtatagcataaataacacaacagttgaataagataaagtaaacatattcattttgataggtgtatagaaattatcagatatgtagtagaaaatatttttaaaacttcttatgtaactttacttataaatgaatacatatgagtttatgtaaatacatgcttatgtatgtatgatatgtgaaaatatacatacagtgatccatgtactgttaatggaattaattttggggggctagttgtgtgtgttcagcatatgaataattttatttttaaaaatttatgtggttcagtatttgttttgtcaaaagtgtgaataatatatatgtgaatatatattgacatattatttagcttttaatgaaaatacttagggtaaaacaaaattctacaagttgggcaaggctcagtgagaatagattttctttgctccatgtaatgtcacctggggcagctttaatgggactggaagatctactaccaaaatagcctcacttacatagctgtcaaattgatactcattctcagctgagagctcagctagagctgctggcccaggatctcctccatgtcacctctcaactggcaaggttggatataacacagtatgacagtctcaagttagctgaactaaaactactggtagttcaactcagggtagttgaatttgagtcccactaagttagagagattagataaaaacctcgagctttctgttgaaatttcagaaaggatgcactttaggaaggaaatctatatgccaggaataaggaattcataatgagaataaggataaaacccaaatagtctcatcccaaaaagtataagaccagggttctacagggtcagtgttgctagccaacactttctgctagaacgaatgccaacatttttcagagaaagacaaatgaatccagtctctaaacatgctactaaagttcatgtagaattttactacatgtgtataaaaaccgagaatattctcacaggaaagataaataagcagtcagactccacgatgacccagatattggaattagcagacaagaactttaaaacagttcttaaaaatgtgttcaaagtcttaaaagaaaaaataaaaagagtatattagcagagaggactcaatatctgaaaaattttaaaagtggatggttttagcaagatttggagaagaaaacaaagtcagtgatcaagaacgtggtgggcaaaatagcttctagatgctagaaaagaaaagggaatggattttctgctagagcctccagaagaaattcagccttgcctacaccttgattttagcttagtgaacccatttcagatttcagacctccagaactatgagaacacgaagttttatctaagacctgaataataagaacatgtcagctatatgaagagtaaaagaaaaagatttccaggtatgagaaaaagcaaaggggaaaggctctgaaccaagagagaacttgaaaacctgagcaacttaaataaaatcatattaactctggaataggggatgggtttgagatatgaggccagagccttaggcaggagccagataatgagggccttttggatcatggtaaagcaggtaggtttcttctaaaacctatcctccacaaaagtcttttaagtagagtgacttaatataatgcatattttaaagagagggcagtattacaaagaatgaatttgagaaggcaagagtgaaaaggggttaaactttagggaagatattgcaataggtgaagcaaaatataattgtggcttggatttacagtggatattgacagcatagtctaattagagatattctggaactcattttagcaggacttaattgtggattttatataaagttttaaggcagaaagaaattgaggataaacctttggtgttttggcttaaacggttgatagaggtttagagatatataacagtgaatgccactattaataaatgactcagttggaaattgatgctagatctgcctgaatccaaagctcttgttctttactactgtgctaagctgaaaaattgtcccttcttggtcccaggttttcttgactaaacaaacagaaaaaaaaaaaaaaaaaaaaaagaaaagaaagaaagaaaaagaaaaaaaagtgagaaagtggttaagccaatatgacttctctcacatttgtgattctctgagatatctaagacttctactcaatttcttggtctacacatcaagaaacatgaactgaatcaatgtatatccaatttaaattacccagttgtgtcagtctgaaaaattcaacattcacatgcacatttacatacacacagtcaagaaataatgggataaattggaaagcacgtgaacttggagtcacaaatatgcttgtttttgagtcttggcacgagcgctttctgatatgtgtcactgtatatgtcatttaacctttctgaaactcaattttttcataagtaaaaagcaaatattaactctcagagcattgtaactaagcaagttacatttgactgtgaaattaaaaactagaaatacttgttggtcttcagtggtccaacttacaaaaattacaatcattgtaacatttgaaaataaaaagatgtgtgtaaaataaaattaataattttcttttcttcttccaatctcaaatataaacactattagcagtttgacaagaattttcatgcagttaattttgcatcttaaacatttgcaaagattacacatgtgcatgtacacacactatatacattctataatttgcttttgctaaaatatatattttagattttctctcaaagtaacacatatatcaacctggtttgtgttaataaccacataataatcaatgttacatttataccaaggtatcaataggtgtaccatttaatcattccaattttgaggaaaattcagattattccaagtctttaatattaataacaatgctataataactatcctggaatatttatcttttaatcctctaattttatttgtatttaataagtggttgaaatgggagaactagtccaagtgctataagtactatttatttaaattatttaaatattaaatttacataatattaaactaaattataactatttaaataccaaattactttccaaaagcttgtaataatcacattattctcatacctagaatttcaccaacagtggatgctattaatttttatttttgctaaactaatgaatgtagtatctgttatcaactttattttttgataactaataataatctgctcttacgtttttgcctgtacttatttcagtgaaatacatgctttttttcttggactttttaaatgaaagatggactacctacatttcttattaacttacggatcaattacttatttaatacttgtttgtcatcattttttcttgatctgtaagttttgttttgatttcattataactttttgccaatgtaagttttttatatttatgtaattaaatgtatatatttttcactctaaggtttctaggatcttagggtgaaccaaaatatgaagtctcctcaaattttaatttttctattttcttccagtcttctttgcttttttcacatctttatctcatcaagagattatatgcacataatgtatagtaaggtctgatctaattttttgtcaatgtaactggtacttagcacaaattattgaacaatggatccataccccatgaatttttttagttcctgtatagggtttaatgtttccagatttcgttctgttccattgataaatatgtctatttctgtgccagccctgtgatgtcatgattatcctagctttttactgtgttttaatatttgctagtccaagtcttagcttatgtttgttatcaaaaccttcttagaaatgttcacctttctattcttttatgtactttatgataattttaattatttcaaaaacactttttatttcatttggactctgttgtatgaatatcagtttttctggaaatatttgtactaaaaaactggaaacttggatgcttaaattctcatttgattgaaccaaaccaaaaggaaactaaacagtaaaagaaaagcatgttgtgcctcagagtgctccaggaaataagtacaaacccagaaacataaacttttgaaaggaaaggtagaactgacttgaagacactagtcagaataaaattaatcacagttgtagtttattaactgcttatttgataagactactgtgtgagatacatggattattcttttcttcatataagaatatcacaaggtacatttaactagaatgactggttaggcatgtttgtggtcaaggaagcgcatatttcatgttttgggaaagaagagatcagatatcctcatttattttcatgctatgaaatggctgagtagcactatattggatggctcacttcagaagaaatatcaactttacagtcttatgaaaagctctttttctaatagtgatggtagaataattacaacacagatagttggagaagaaagtaccttttatcaactctacatccctgataattggtaaggagcaaatgtggggaagtatctattgaggaatctctagaagttttacctatccataaaagtgaaacataacaaaatcaaactaagtcacagaaataaagtaaaattgtcaaaaacgtttaggtggtgagacttggataatactgaaacatttccaagaaaagctctgaaatacttttcagatagaagacatatttatatggttaggttagaagacaggaatcttgcctgaaggcaaagagaaaaatagagaaatttcaaacaataccaccacaacaaaaattctctttaatctggtacctttattattttttctctcttagttttttctcatcattcaatatactcctaaatcttgaatgctcttttcctaaactgcttctgccaatttttctaactctgaaatgtctgatccattactgagttcaaagacatatgcacatgactttaaactttgtcacttctgaacccagagaaaaattaaatgaatgacctataaaacattttatttaatagtaaatctatgtaatataaagtatatagattataatggtatccaattttaattacagcatatccccataatgtgtaatatagagaaaagctgaagaaatataaatgaaaaaatatttcaaaggatgaaatataagggtttatttcaaaagtgagaataggttagctgtcatatatcactatctttgtatgagacactgagcatatctggctgactgagtggacattctcttccttcagcttcctatgtggttccctaaaagctatctacatgaggggaaatgagaatatttaagacaatatgtaattactgaagtagcatggcatcttagaaacgataaaacacaactgtggatatttaataaacaaaaatacacattagaaatcttgcccagtgtccataaggcccaggagtaataggaatcctgtcatctaagcctccttccaccatactcaccactttatttacctgtctcctataattttattctttttaacttccttcttgactacttatatttttgctcttgtaattgatgcagtgtctatgtttagccaattgctggaacacctttaaagttgatacttcctattccaaatgtagaatattacttagcttactttacctaatttaccaaactcctgtctcccattttctagaccctttagatgccagggctctctgttctaggcactctgtccaggaacttgaatttatattgccttcctgctctccctcagaccctaccaaatgatctgcaaatgcatttgagaatagagtcaatgacctcttcacatttgaaatgaatgcaattttatggggttttcataatataaaaccaaaaaaaaatttttgcatgtctgtatgtaaatagacaacatatagcagagtaaatggtattttataatagagtaaaacatagcaaaaagttaccatgtaccaattagcattttactttcaataaatattcaatccttaatataaatatgtaataaaaatatataatactctatatatcatataattttattattcaacatctacagtgtattaggttgtgtctttaggaaatcattaattaatattatttggtgaaattatattggtacagttgtttgcatcacaacaaaatgttttctaagaaatattttgtaatattaaatgccaataatcaatttctcaagaaattgccactagattttaataagttagtgttatattaccttacatctcactatattttcatacatttgaaaagttcagaaccatttcaaatagcaagtccattttcctgttctaaatttttgtctaaccaaactaattgattttgaatatttcctatgtgtcccatatgtagtgctaaaaaaagactaatgttgaactttaaagtggtatttcactctttcttcactggcaaatctcttattaaaatggaaataatcatttgggtttatacagtatcatattatcaaatgtaatgagaagagcctatttagaatttttagatgcaatcttggtaatgagaattaattttgccagtcatgtaagatatatatctaaagtttaatttgtgtttaggtattattttattaaatatctaaatcttgggaaatattaatcaatgtgtttgacttcagaaatgcttgccatatatccatcacatttgttaataaaatgaagtcttgacagattaaaatttttgcaggttagaagttttcaaagaaaatacagcatatgaaaccataaatggtaatattctccaaaatcttaagtcaaatgatataatagcattaagaaacaggtaaactcttctcattagaaaaatatctgatctaatgaaatgtcgaaaggtaacttagaaagaaaggtggctactgcttactcatttgctgtggaagaatagtagaaataagagtgacaatgattcaccttttcatcaaacaaaaatctccttattacattgagttttaaatcagcagaagtgtactgaactgtccagatggtaggattggactgaatattagaccaaatgcactaatggttcctgacaacagtgcatggatagtgctgaaacatgacaatgtaagcagaaggagtctctctttctcagtctgctcttcctttcctctcctccaacctcatctagcctgacatttgacagttggcagatatttcatcccaagaaatggggccaaatctttgatttgaatcagcacatggaaattgcctcactttaatgtccatgacaaatttgtttgcattttctatttcttagattatgtgaaaatgcttattaaaataaactggaaatttggataagttattagattccttcttttgttgaactttctcacaggtgtaaactataacactacatttcttttagttgaagaaaaaagtaccttgtcaagaaaattagactttgagagttgttaccttatttgtgcttctgtcttttgaacaacctataaatgtaatgtcattacattttttttttttgcatgtgtttagtattggagataattgtcttttgtattgagagtggagacttaggatttgtggtcaaataattcagcattatgcatttgggccatatcatatccattttagaatgagaggaggctgacagggcgcagtggctcatgccggtaatcccagcactttgggaaaccgaagcaggcagattacctgaggtcaggagttcaagaccagcctggccaacatagtgaaaccttgtctctactggaaaaaacccaaaaaattagccaggcgtggtggcgggcacctgtaatcccagctactcgggaggctgaggtgggagaatcgcttgtacccgggaggaggagtttgccgtgagccgatatctcaccactgcactccagcttgggtgggtgacagtgggagaatccgtctcaaaaaaaaaaaaaaaaaaaaaaaagccacaagaaagaacaaaaacaaaacctagaattaagctttctaaatgtataggtatatgtgctcctataaaatttttattcatttattcaacaaaattttatttagtatacatatcctgtttagtgttgtggatacaacagggattaaagagtcagtccttctcccaagagacttacagtaaaatgggaacagtggaggccatctcccattttatttctccataacagtaaagaaaatttcaaaaacaaatttctaaaaatatagaatttatattatcatacaaattatttaatatctagagataaattgaataaatatttgtaagacaatttaccaaaaactgttattattgagataaatttaaaaatatttaaaaatggggtagatatataacatgttcacagattaaacacttaatatttttaagatttaaattttttctacatgtatctatagattcattatactcttaatcaaaatctcttcatttaccttaattgttagtcaactcacttttggatatatactccagaaacacttgtgtacaggtaataagaaaaggagtgtgaagatgcttatctcagcagtatttggggtagtaagaatttggagataacctaggtgctcattacgaaaagaataagtgaaaacagatggataaattatttagaaaaaagtacataattttaagataatgaattagaaatatattcaacaacatagataaatcttaaaatgttggagagaaaagtaaaaaacaaaatgaatgctatagaataaatccatagcacgataaaaatttttgtacatttaaagaatatacacaaagacaccatatatttctcaaaattacaaacatttaaaagatatatttgagtaagtgcctgttttaacaataggaatggagatttgctcagctatgtagatgaaaatgaattgaaataaagaacagctttgcaaatattaaggataaccatgtaccatgaataaaagagtatcttctattcatggcacattaagttctcttcaactctattcatcagaaaaatacatataaatataaaataaagtattgaaaaaacaggagtcatcagttgggtctactattcttaaaaacctgacaaacattaaagaaaaaaacgtttcttgaatttggcattatggagtttttaatgatctcaacaagaacaatttcggtaaagtgggaaggataccacaactcaacttgctataggtgccctctggcccccaaaattcacatctgtcccaagtgcagaatacattcacaccatcccaacgtccccaatattgcaacccattaaagcatcagctccaagtccaaaatttcatctaaatattatcagttttaaaagtctcatatcttgtattttaaagccatctaaatcaggtatgagtgagacttggggtataatccatcttggagcaaagtcattattcatttgtgaatctgtgaaactaaaaaacaagttatcttcttcaaaaatgccatggtggaacaaacattgaataggcattctaattccaaaaggaaaaaaaaaagggaagggataaagaggttactggtcccaagcaagtttgaaatccagcaaggaatgttccactaggttacaagacatgagaataatcctctgtggctcaaggctctaccctctgggctcacagcagctctgtcctctgcctctgtgcctgctgtctcttcctcagccccactggcttctgctccttccatgtcagactcggcctctgcactggctacatcagacccacaaacccaggtggcctctgttcacagcagttctgtcattggagttattctttctgtttcttgaaggacagcttaggtttgtagccaagtaattctgttagttcactcctgtttgtacaatcctagaaatctgacagccttctgtatttcatctcttctctgtctccttcagctcaagctggcagtatttctgctgatacaacattcttgcaaacctaacgaatttcctttatatgtcacagagatacatgccactgaaaaagagggtccttcacagatcttttctgaatcgcctatcctattccaggagtctacctgagacgacaggaatcacatatcgaatctcttcagcaaatgatttctttggccctctctatagagcacactttttcaatagtcaatagcttaattttagcatcttttgcaatctggatagatcaagaatatcccagatcatccagtcctgctccctcttttcttaacatttctccctcaatttcttcctttcatcttgcattttgctataggcagtaaggagaaaccaggcttcattttcattttcaacactgcctgaaagctacttggcaaaatattcaattctgttgcttacaagttctgcattccactcagcagcagagggcaattgatctgctttcttccacttaatagcaaggatcaccttacctctaatttccaaatatgtttttctcatttctttctaagacctctccagcaatacctgtaaattttatattactaccaacagtctgttcaaagtgatctaggctttttctatcatatgcctcaaaattctaccagtttctacccattagccaattccaaagcacttccatactttcagatatttgttacagtagcatgctactttctggtaactaaatctgtgttagtttcccagggctgccataacaaattaccacatgcttcatggtttaaaataacatatatttagtttatcacaattctggagaccagaagtctgaaatcaaggtgttgacagagccacacttcctctgaatactctaggggactttccttccttgcctctcttccagctcctggtggctccaggagttccttggcttgggactgcaaaactccaaactttgcttccatcttcgcatgcccttcttccctgtatccctcatgttttcttttaaaaggacaagtcattgaacttaggccccaccttaatccatgatgatctcatcttaaaatattttatctgcaaagtccctttttccaaaaattgtcacattcacagggaccgaggcataaacatgtttgtttgtttaataagcagagaggccaccttttaaaccactacacgtttttcaattaaacacatttaatttcgaagtcacgttgagggcaaagactatatttccttttcaattttatgtctctgtgtcttttgcagcagctctgcactcaatgaataattattgtaagaatcaaaagtgtatttcaaaacaataatcaaagttttctagaagtctgctaaataagttaaactaatttttaaaaattaacacattttgtatcagtagaagaccatggtttcatagtatttaaactaagagtccagattctgattacaaaataggccactgtcccatttagcaaaattctaattgtatgaaaaaaaatggccttgtgtatgaggttaaatatgtgaatacaatataaaaaatttggctctaactattggtaatcatagataaatattgcttttcaagtctacattgaaattggctcaatttaccaccgtggtcaattacatagccaaatacattcttgatgggacttgtgtaatgggccatcattctttcaagaacaaaattgtttcctattcctgtgatttgataataagtaataaacatataatatatcaatttataaagtcaattacataaacaagaagagtgccaacagcaataaccaaaacactctgtactgtatttactttcatattctccaccttccctaaggcaccaggcctggcatttttcctactttctcaattttctttgcataattttccacttggtggactgccattgtcaacagtaacactcttcaacttctgcaggcttggtaagagcagttgaagagatgagaactgtgtttaattaaatcctggttgtcaaatgtaaatgcaaaagtgcttaattattcaacattgctagtgatgaaagtcagaaaaaaggctccagaagaagtttggtatatcatgatcttttagatacaatcctgaaaagtatcaatttcccctttacctcctttaaatgaaaaaaaaagtttttaaaggaaagcagatgaacacatatataactcataaaatacctcgctgaataattctagccgctgaaaaagatacatatagaaatggattatgtggtctcaaaattatgtgtaggctatgtttcatgaaaacatctacaggctttgtgattcatgtatatttaaggggcatctttaagcaaaagcaaaagaggaagggaagatagaatttggggacaagaaacaattacactttaaactttgattttttctttctttcaaaacttgttttagttttcatggcatcatttaaacattatagatttaaaagtgcttgggattaattagttcaataaatttaatgtaattttagtcacaatactaattcctaaggtgtttttgagtaaatatgagtcaaactcctctctaaaagaatacctaccaagttattttttaagtataagcacaaatatattaggcatctaccataggcttacaatcctattcctttaatatgcatgtaaatataaatgagataaagttctttgggtaaatgttcacattttacacagcattgtatatgaactctttgtttctttaactgattcgtttttattacaatgctgatgataacatttggataaggtggcatgttaagttttaccatagaatagctaaacagaaatagattaaattttatacagatgtggttatccccagatgtgaatgtaggaaaaacttagttttgtctctgggtatttattcgccatataaatctactagcacattcttatctgttatgtaaataagatgtggaattccaatagtgtatcagtgttctacagcagatggtacgctgagatttaccacaccattacatttaatgggtttgaattcatttggatttcttgatgttctctctgtccttctcatagcagcaatgttgccaatgttcctgattatatatgatttgagagagtgcttaaagaagaaacactcctttttcttagaaatatgagtattttatgtcaaagtttaaggtgtgtatgtattgcatttcagaggatttatataccctatgaggaaaagatagttaatgaatattcaacaaaatactagcagtcattacactcaaagatattttataaaatgggaatacacaattaactattatagtgctagtagggagtgttcatttgaaaaacaaaaagaaattttcagcctagttcatcatggatgaagttttttaaaaactttaatataagaatacaaagactcaagaaggcacacatcttagtcataacaaggcaagctattcacgagtatttcagctaacaaaaatttatatagtattagctcactaattactcaagaacaatgaataacatccctaaatgagttggatctataaaaggtcagacctcagcgataattgaaaatgacaacacgagccatatgagcatttttgtttctgaacttgtgctatttagaagcagagtgagtgctggtgtagcattaatcagttagttacagaaattactgtggatgaacatagactggaacaagaataagaaattcaatgtcaaaaatataacctatattttaaaatcattttgtctcaaagggtagccaacaaaacactagcatctaaattacttctaaaatgttgttaataatagagatgcctgggacttatcccagattcactaaatccaaaaatctatggggctaaaacctaggtatgaaaatattaaaaagatcccctgtagtgatatttattatgcacatcctgatatttatatatatatggcaggccaaaattcaaattcaatatctaaagcagacttcttgggtttaaattgggcttctttacttaccagttctgtggccctgggctcattacttatcctctccatatctgagttctttcaactctaaatgaggctaacatacctacatcacagaataattatgaggattgagttaatgtttataaagcaactagtacctagtacatgtaaacactaataatataggagtaaataaaatgtctccttagcaaaggagatgaaagatctctacaaagaaaaccacaaggcattaaggaaataaactgtagatgacacaaattgtaaaacatcccatgactatggattggacaaatcgatattaaaatgaccatattgcctaaagcaattcacagattcaaatcactttctatcaaataaccaccatttttcacagaattagagaaaaacacttcaaaaattcataagaaaccaacaaagaatcagaatagccaaagcactcctaagcaaaaagaacaaatctggagacatcacattacctgacttcaaattatactacaaggctatagtaacccaaaggttatgatactggtagaaaaatagacacatggaacaagtgaaaagaatagaaaacctagaaataaagccacttgcctacaacaaactcatattcaacaaagtcaacaaaaataaacaatgggaaaaggacaccctgttcaataaatggtgctaataaaattggatagccatatgcagaagaatgagactagactcctgtctctcaccatacacaaaagactcaagatggattcaagacttaaatgaaagaaatgaaactataaaaatcctagaaaaaacacaggaaaaacttttctgaacattggccaaaggaaaaaatttatgactaagacctcaaaagtaaatgcaacaaaaacaacaatagataaataggacttaattaaactaaaaacattgacacacaccaaaataaatacccaacaggggaaaaagacaatctagagaatgagagaagatattttcaaattatgtatctgacaaaggactaatatccagaatctacaaggaattcaaacagaacaacaagaaaaaaatcaaccccattaaaaagtcggcgaaggacagacatttctcaaaagaagacatacaagaagccaacaaacatatgaagaaatcctcaatatcactaatcatcagagaagtgcacattgaaaccacaatgaaataccacctcacattagtcagaatggccactattgaaaagtcaaaaaccaacagatgttgacgaggatatggagaaaagggaatacttttatgctgttggtgggaatgtaaactgtacaacctttatggaaaacagtatggagatttctaaagaaactaaaaatagacctaccattcaatccagcaatcccactactgtgaatctacccaaaggacaagaaaccaccatattgaaaagacacctgaacttacatgtttatcgcagcactattcataaaagcaaagtcataggatcaacctgtttccattaataaatgattggagaaggtaaacatggtaatatacaccataaagtattattcagccataaaaaaagatgaagtcatgtcttttgcagcaccatctacctatggagctggagcaatatcctaagtgaaataacccagaaacagaaaataataataccacgtgttctcacttataagtgagacataaacaatgggtgcacatggtcataatgatgggaagaatggaaacggaggatttttaaaagaagaagaatggaaatagggtgagggctgaaaaattacatattaactataatttttgctatgtgggtgatgggtacactagaagcccaaacctcaccattacacaatatgtccatgtaacaaacctgcacatccatcctcaaacctataatttaaaaaatttaaaaatgaaataaaaaatacaaatgtctattggagttgcaagatcatagttaaaaataccatattttctattaaaagacaaacaaaaacttcctagaaattatccgaaccctaaatgtaacacaaactatttttcctgattggaagataatagaaaccaaagtgcattccacattgtttttgctttcttcttcattataaggttataataaatatgtttaatgttattagactcagtttccagtcatactctgaataaaacatcttttcaaactttttccatcatgaaatatatcaactgtggtgacatacccattctcatgaatggttaacatgattttcatagaataagatgagatttaactctcttggtgcatatatgtgccatgttactttcagcaaatcatttcagtaatacagcatgacagtaactttacagtgacactgtagacacagtattccaggcactttattttcagttcatttgtgggatattggactcatttggcagtagtactgaagtcacattcatttataggcacttcaggggcatccacacaacatcttataattgcactgcaatagcctgccattgccatgtgtttatcaattttcagttcttagaagacttttcaattattatctataagcttgttaaatttacagtcatttgtcaacatttagaacaagaaaagatgagtgctaaagacggaagaacatgattatattttatttgacttatagctggctttttacctgatgacaattaattccaaaaaataaaccccaactttaatacatcgtgatgtcatcattttactcattctaatatcaaaatctcaaattttacatatatctcatcagaatcaactgacaagcttttctatattgaaggcaatatttctgggaagtccataattgtacttgcagaattattcacagaagcttccagtaagtctaattacttcttcaaattggcctgaaaagcatttagacagtagggctttccgttggcccagaagtcatttgatctctttatgacttccctaagctagcagcagccatttcagattggctctgactgtgaaacaggcaatggtacatctgttttttggtttgttttttaatgggaaaaacactttctaagaaggcaaacttcatgtccttacttatgcaagagttatgtgtaacccttttaagatatgtaaatggatgtacctctggaaaaaaaggttcatctgaatctaattctgaaactagaggaatgtacccaggtcattttattatttatttacatatatgtgtatgtgtgtgtgtaaaataaaaatactaccaagttggttcaggctgactttagtattttaaatataaaatttaacaaaatttggaaagtgttcaaatcttacattttaagtagtgataagtaaaactaaaactgaaatgtgtcctttgtgacatgatctttgccttcttggagcttacaaaatatagccacctaattttttaaaattagcatattaatactttaatataaatataaatgcaaatgcttttgcattgcagttacttggaaaagacttcaaaaaataatttgctatataccttaatctcaggcaaaattaagactaacatactcttatgaaactaaaaatggtacggtaataaaatcatagagtcatttacaaaaactgttttaatacattcagtcttttcccagtctcaccatttgaggaaatgttaatttatcgtacaatttgtgataaacacataaagagggatttattatcaactgtaaaatctattgtaattgagatctgatgtaataatttggataactcttcaagtatttgaagctatcactgaaccaactagtaataataaatcaatttaaatactaaatataatgtttttccttatctataagtcactgatattattaaaaaattagaaaatacagaaaattttagatcatttattttaacattacatggaatttggactcaatgctggatttatttatgtcataacatttgaagtacctatagatatagatacttaatctatatctatagatactgaaatattcatgacccagttactatatgtgtatttgtgtatatatagatacttaaatattcatgacccagctactatatgtgtatttgtgtacatataataacacacacacaaaagtgcttgatttttaaaatattttaaagtttaaaagagacctcaaaatatcttatataatgacaataataactcagtgaaaatcaacatgcagatgtgttaagaaattcatgttttcctctgatatttccatcttggaaatgaaaatatttaattcaatatctgacaggtgcatcatacatacaaaccttctatattcctgaaaaccacctttgacttctgtatattctctatacttcacatctaaacaacttccaaatcatgcaaatatcatctgatttatttaacaaatgtttattgaacatccactatattacagacactctatagatgctaagactacaataataaaaaaccaaaagttataacttcttccctcataggacttatagagggcacaggcatcaaagcagaaaaatacataaatctaattacaacctgtgttatgtgcaatgaagaaagttaaaataatctatagtgaagggaccttaactctctgaaaaattcaaacagttatccatgaagaaatactatttgagcccatctgaggaatgagttaaaatgaatcaggagcagggaattgactcattccaggtcccaaatccctgaggacaagggagggaaaagtcaatactggtcagcacagagagtgaagaggagaatagtatgagatgaggaagaagttaggtaagaagaaccttatagagtaggaggtttttttaaagagcactctagctgctgtggacagaataaattagtgggagacaaaagtacacacaataagaacacttaagacaccactgctacagtccaggcagaggcgacaatgacttggagtaagatagggcagcggaaatgcagaagaggataaaattgagagatacttaaaagaaagaatcagaatgacttagtagagttggatgtagggaatgaggaaaaaagagatatcaaggatgatttctagatttctgggatgcataattagatgggtagtgctaccattcatcgagatacagcaatgtagagtaggactcagaaaaggcaggagaaaatctattccagctctgagtaaactgagtttaaagttcttttgagacatagaagtagaaatgccaaggaaacaagtatagagacacaatgattgtaagtgaaataggggcttaattttttaatttttaacaccaataattcaaagatagtaattgaaatcatgaatttgagtggtaatcactatgaggaccttaatagatggaaaacaagggtttctcaaagtaatttgttgtgaatattgggagtaaaattaaagggaataaaatataaataaaatataaatgaaaaaataaaataaagacacatcatagtttccagagaatattaaacagaatcacctgaaaattgttgatctatgaagagacttgagttaggatgtcaaatatgacaataatgtacatttttcccagaggatagaatactacaaaataatttaaacatagtacaagtctgtagacagagaaacctattaggagctataagaattataaaggactacttatgttgttctgcgaacaatacagccccttccagatttatattattagtacatgtataactggaaaatacgttgtaaaatacggctcaatttaatctctcatcaataagccaatctcttgctctcatattctgtctaccattaagtattagctttacggtgtaaagaggtaggaggatgttacacagaacaaataaaagagattcttgctccttttgtactgaaaaatcttaagagtaggaagaataagagacataagaatagaaagagggtgggacaggtagatcctgaacttttctttctgtgtttagcccagagaaaggaaagtgtattaaaaagttgagagaaacaaaaaaagttgaagagttttgcccaatgtaagttttaagatttaaaaacatgtcctttaatgttagcttcttgttacctctaattcttactcccaaatcctgtccctgaatgaatttggagagcaactccatggcaagtgaacttggcacctcagtggttaagaaattaaataactaatgtttaactgtcttaaactgtccttcctatgttgtaaggatgtgactcagaggttttcagtctccttgggattgggtgcacagtatggagttggagctttccaagggcactggggagactgaggagtggacaccttgtcagggtctagatgaaaggtatggtgaagcattggaaagggctttttcacctatgcatgctgagagaagttcggaacctgaagatgcagaccaggctctgaccaagcctgcagagctcagatcacatgctacacagaagccaaaataagcaaccaggtgagcactgaattggcagtccaactggacacatactagtggggagaaggctaaagcagtcagaaaagactgcagtgattaacagcaacacaagcaaagccttttcttttcactagtacaaagtccctctcatacatcagataccaccttggataagaaaaggaggaaagtgaaaagagaaaattgaagaattgagcattttgctcaagtgactattctcattgcattaagctaagactactttattttctttttttaatttttaatttttgtgagtatgtaatagctgtattttttccctatcttgaggttcaagaggctcaagaggaaggtcacgtaacttaaacacataataaagaagttacctttttttaatacatctgaggatgatgcaaatcaatttaagccatcatataaagttcttaaaacctatatctaacttgcttgtaaaaaccttgaaacatttttagtccttttcataacagtgcgcacttcatcatcattcttcagtttcagtatttctgttttaaaattttattaaattcagtttggacattgaaacagtagagcagtatcataaattatacggtatcatgtattccaataagatatgataccattagataagaagtgcagtgcataaacaaattcatttaatatattattttcatttatttaagcattttaatctggattaaaattaacaaatttaagaaggagttcaaaactaggatgtaaaaaactggacctattgatgaaacattgttaatgttttaatctttattagtttgagataaaaatatgagttttagatttgtaacatcagtaacttgtaaaaattcatatgtgtgtgggcgtctatcatctatatgtataaaacttaaaactatagataaaaaataaactttatataatctttacagtatgcaatttttcttctgggcatgataggctttatttagtccatttcatacactatgatttcagaatactatcaaaatatatgtattaatgaactaactactctacattattaaacagctatatatgtgaacacaaaggttgggataagaaccgaatatagtcatttttaataaaatagtccaatgcatcaccatattctatgttctaattaggttctattgtggatttgaatttttttaaaagctcaaaaataaagtatttttgaagctaattaacttcagtagtttcctagagacaagatgtcttattccttctgttcagcaggtgtgtgcatgtcttaggcaagaataagacaatttagctgaggttgtatttgattagattgattaaatatgcattttgctctgtaaagacaaattttatgtatattagttggacaactatttctaaaatctttgagcttttctttatttcatgctgtctgctcatgtctgccatggttttgaacaaagaaacaagctattttcctgaaaatgttaatatatttccaaaaggtgttttctacctcatctatgatattttgtaccaatagagtcaatgcattgcccgtttcactgtgagtagaaaaaaaatttctatgttcactttttggctgaaaaataccaatgtgaagactatatatttgcatttgtttttaattaagaaaagagtaaattcttttgaagtaataattgcaggtaatgctcagagccaaacattgttttaagagcttcaaacgcagtaattcatttaatagtcatagaaaatctacaagacagttattattatctacattttatagctaaggaaatttggacacaaagagtctgaattgcttggtcaaggtacataattacaaaagagtctaactgagatttttaatccaagcatttaaccactaatccgtatagtctcggttggtgttctattacatttaagtacctccagacactcagaaacctccctctatatttttacaaactatgccaactcagctgccagtacttgtcatttacacttcttcaatatttctctcattaatagctatgctgtattttgtgttctaaattgtgctgtcatctcattttgcctttttttttttcataacatcttcattgtcttccacttccaatcccatttataaacatacatcaaaataaacattctggcatcccttagtaatagaaacactcaaactaggaatcaaagaaaactttcccagcctgataaatgacatttacaaaaacaataactagcatcataattaatggtgaaagacatgactatgatgttctccattgccacttttgttcaattctttactaaaaatttagccaggacaattaggcaagaaaattaaataaaagatttccatattggaaaaaaataaagaaaaatatctctatttgcagatgacataatatttacataaaatcctgagaaaagcactaaaaaaactattagctaataaatgagttcagcaaggtttcaagatacaagatcaatacacaaaaatttcatttctatatacttacaatgaattatctaaacacgacaatcagacaataattccattggcaatactatcaaaaatatataatacataggacaattttaacaaaagaaatggtaaacctatcacctggaaaccacaaaacattgtgtgtacaaaaaaatgaattttatacatcaaattgttgaataatatggaatctgagttatatctccataaactttatagatagatatatagatagataacttttttgaagtactcccttctcagaatccttcaagtgctctctctagtctacaaattggagacaaaatgcctgtgcataaactaaaagctctcgtgatctggcctttaccattttgttcctttctcactccattaatgatgcattacaactaattatacctattgctcatattgtctctatattttctctttgtcctgccttctctactcaagagatacctatctctccatatttccgtgtaaatcttttctaacttttagtcctcatccccaatgccatctcttctctgaaagaaatgattctcttctgctgtacccaacctctctcacctctgaaacttcataacactctacctccgtacctctctcatatcactgttcactttctgttttctagcatggttgagtcaacattacaaaaattccttgagagtgggatttctatctgatttatttatgtatttattttatttttgagacggagtctcactctgtcgccaggctggagtgcagtggggcgatctcggtcagtggcgttatcttggctcactgcaacctccgactccctggctcaagagattctcccgcctcagcctcccgagtagctgggattacaggcatgcaccaccatgcctggctaatttttgtatttttagtagagagggggtttcaccatgttggccaggatggtctcgatctcctgacctcctgatctgcctgcctcagcctcccaaagtgctgggattacaggcatgagccaccataccgagcttaatttatttatttttttcacctcctacaaaactaataaaatagcctgcatgtaactggtgctcaataaacactttaaatgaattaattatttattcaagaaagagaacatgaataaatggaaataaataaataatccaatgaatgaatgaatcttattttttctctaagctttttaacgaagcgtctgggttcttatttgcaaataacagaatctggtgtgattaatttagacaaaaatttttttaaagtatataatctcacagaatctctgaaagggctagaaagccctaattctcgttatcaggaacaaagcgaaagcatactgcagatgctgatgtagagaaaatgccaccggtacctaccagctgatcagcactcatgagatgcaagacaggatcacaaaactctgttaatgtcacccttcaactgaacacaagttttagctagaatcaacagaattaatatgtgtaccttcctagaatccatgttgaatacctctcctttcagaatctattgcttgtggaaagtcaaatatgtttagcaaggcatgaaacaactgtagtcattcatcagtggtcacagagtcacatttaagcataactttaaaggtttcacagactttagatttattattctgaataaacattactctcatgaagatgaactggtggttgaaggcctgtaattcccctccatctaggtacactgtcattagccataatgaaaatgtctctgggtttccatgtaagtgcacattgtccaccttacaaggtaatactccttagaaatgagaattcatttttttcaatcaacaaatatttatattgttcagatatgtccaattttgccttgacagttatggtccaacaaagaatttagagaaaaaatatcacaggtaaagttgacaaggaccagaataattttaatgaaaagacaattaaattatttttaaaaattcactgaggcctttcatttcttagcataattatttttcattatggttaaagtaagattctggagccagcaacataagtaaaaaaaatccagcaaaatttattgatgaaaaaattaggctttttttttttcagttgagaaactctagaaatgctgtgtttctcctcccagcacccacagccatctatcctgtcccacaattcaacctgcaaacagattaagcagctgagtttgtggaaagtatgtttgctctacgctaagaacccttgtgtgacactatggtgacacccctgacacttggaagagtactacagatggttcttacatgtcagcaggaaaaccaggctgagaattcacaatttgtttgtaaccccaatttcttcgtagaaatcagtagttggtaaaaaagcagaaaagattttaaacaacttttttttggtcaatactgctcaaaagatatagggtgtcctatatttcaaaagacaatctgcaacttaaaaaacctataaattgaaatgttttaacctgattgttgatgttttaattatgctataaaaatttaagatgagcagaagtcctgtacattttaaataatggattttttctttttaaaaaagtatggaaagcatgaaagttcttgagttgatacatcttttcttgcaaatctgtttaaaagtttacaattttttctatatctctttgcctcatctattcattatatagttacagtatataaacttccatgtctttataggccccaacattcactcaaccagaccaagcgcataccaagctacccttgggtttcaatactgacttcgcaaaccagtggactgagagagataacaattcaagttaaaaatgagtgcagtaaatgttaagcaatatcacttgccagtcataaaatgaggagaaaaatagtatgacaaggataaccctcagtagaaggaaccaaattatctgattgtagtattatcagtcttagaaaaagtcctgatttcgttttcttttcatgagtatctgatgtaattttgtacagttacttaaacaagtcagatggatattctagtcttttacttaaaagtgtaaagactggaaaactccaagaacctgaaataccaaagcccgagaatggtggaactggcattgtgggtcaatcatttaattactattgagcctcagttttcttaactctaaaacagaaaaactatgaaatacatcatatggttgttgtagatactaattaaatgagatacatttaaaggatctaagagactgcctggtctatagtaggcaatagataattgggagctataattacttacttaagcatagcatgatttacatatcaaatatatttgtaattatcattattttgtccggtataatagtttcctatgaataatttatagaaatagcacaagcattattttcagcactgaacaggtgggaaaactcagacaaaatgaagttaagtgatttaactaagaagagcaggaaagacagagctacaattattttatcttacaattatactctttctattaattgggtgggtggcatatgcgaaggaaaaaaagagccaaattataattgacataagagataaattaacagggtaagagaggataggttcatttttaatccacaaatctttaagacaccatttttctttataaaatcatagacttcatgagtattaaaaggtattcatttttggctacccatgatatcccttgtcccccatatccaatcttcattttttttgcaaataatttttggctaatcatatagccacacagagcaatactttatattccagctttgcttgaagtcaggtgaaaccatgtgataaagttctggccaatggaatatatcagaaaaggtgtgtgcaaattttggctattcctttaaaataagggaactggcattccatttcccttataattcatctggctggctagaatgtagctatgaccacaggagtcggaacagccttcttggaccataagatggaagttgtctgttgaggatagtagagcaactagagagaacttaagtctttgaaaactttgatgattagaagccactacatcagcttggaattgtatatgaaagaaaaataaacttctatctcatttaaagacagaattatattttaatgaaggtcagctcatttattctactgttgctactatccctaccattattatatgggcaccctttatcacagaatcaaagaaagctatcagacaggttctcagaaaacaactagatcagcatcttgccacccccatcacatatttgtcaactcaggcaacaaactctcaaatgctaggattttaaatacatctcaaaaattgcaatttaatacaatttctcctgaatcatgcctaggttttggtttttgctttacttctccattcagtagtaaaataaaaaagaatatatcaataatcataacataatgttatatctatgttacttattctagtaatttaacttttaaataaagaatataaatattcataaaaattattaatttataaagtgaggtttaagaaccacatgtattctatgatgcagttttggcttgaaaatatacatttgtatatttgtgcatatttgtatgaagtgtctatgtctattcgatgagaaattatgaaagtttacacagcaacttctcagtaatgccctttgggagagcaattaaagataacaagtaaagaaatttggcttttttattatatacttgtgtattaattgaactttccaatgagcaattatagtttttgttacctattttcaaaaatttgctttaacaattgtatatgatcccatcaaaaacagccataaactattcaaaatacaagaacataaatacaacaaaatgaatttttattatttcaatatattttatcttatcttttatctagttaacataaactatatggaaaaaaaaacttctctatacagagcactaaagcaatagtgagtaacccagcaggaacttctccatattcaagagactaagagtaaaagcagtgcaggtaattgccaaggtctactgacaaatactaagtcagggtatatacaggaactgtcttcctcattgtaaacagcccaaaatagggtgtgtgtgctaaaaaaaaaagacaatgaagatgaaggaaaaggagaaaggaggaggaggagaaagagaaggaaaaaagaagaggaagaagaaggaggagaaggacaagagaaaaagaaaaagacagaagagggagaagaggaaaaatattaggactgaagaaaaaaatataatcagattattattaatctcaaatgtaacgattatttctgaataaaaagataaatctaacattttcattagtcaatgcctctactattcaattactgaaaaaaataactaagtatgttcttgatataattaaagatttcatcaaccacgagcaaacttctaaaaaatgtggaacttttataataaaataacatattaaagtagagcttcaatatatacagtaattttaatttttttaaagaaaatcttccaagtaccaaagcaatctactttgctttgcctgttctcgttatctgtcaatgttttgcctgaattaaacaaatcatgaataaaattagtaaaacctcaaatacaaaagatacataataaagagctaaagagttagtctataaataccatagtttgtatgttcattgaaggtagtaaatatgactcatcttctcgttaaattgaccatagaggattgtgaaaaaattaatacttgatgtgttattcataaaataaataaatgtttatattttgaaagtaaataaagagcaactttttttgttttaatcagtatagattggaaataaaatgtaaatgacaagtgatatttataatcaaaaccctaatatctagatattgtctttttgaacaaggttgtgggaggtgaatgcagagctagaggacacctaaaaataaaagacagagatgtaatacgttttccttaataaataaatactgtgacagaatagggtgagcttctgctttgatatgttaacttttttccatttaaatttcagttctgttaaatcatgcagggaacaaagataaagttgggatttaatttaggggtaggttggagaggaagaagcaaagacaggaaaacaccagtagaaaacgctacagaaacttaaacagtaagagagctaaattaaagtgattaaaattattaacttccaatgcaacctgatgatgtaaaatctgttgtttcaagattgaaactataaatctaaaactcctgaagcaatggttagttaaaataaaaaaaaatgaatagtttctaccacacaataaaattattattattattattattttaagacggggtctcgctctctcaccaggctggagtgcagtggtgcaatctctgctcactgcaacctctgcctcccggtttcaagcgattgtcttgccccagtctcccgagtagctgtgactataggagcgtgccaccacaccccgctaattttttgtatttttagtacagacggagtttcaccgtgttaggcaggatggtctcgatctcctgacctcgtgatccgcctgcctcggcctcccaaagtgctgggattacaggtgtgagccatcgtgcccagcctaaaattactttctaaataggtaactgagctatagaagaaaaaccaaggtttaattctaaataagggacaattaaatgaaaattacaatgcaagtctagttacaaaattctttcttactatatttcaattgagtaatataattgatttttaaataacatggttttaaaaatttgtttcttagaagaaaaagagaagaagaaaaacaaggaggaacaaaaataaataatgaagaagcagccattgctcagctatttttctattggctttaaatgaaaagagaactgctttgacgtgaccattacaaggtaccaacaacatccggcagcaattatcttgtattacagtcctaacatacctggatagactagccaatctttatgccattttagtgtttcgtttttaataaaaatgtccataaatgtgtatgcatttgcatgtcttatatagataggaaacagaatatttgattactttatcaagagcttgttcagaaggtttgtacaatgaagataatagatgttctatacaaaagaaaatacaatgaagagcagaaatattacaaaatgtgcaatagtaaaatggataaagtaattagataataaaatcctagtttgaaatatagtctaagttctaaagttgtttttttcattttttaatacatattagtcttttatggaagacaatcttcttaatcatctaaaattatcacaggattttgatagttcttatatatcatcattctttatcaattatgtccttcatagtattctcaaaagtataaataatttagggacataaagaaatgtccacctcataatgactcctattagatccacatatactcattcatcccccaactacttatttattacttatatattgagcacctactgttactcaggcactatttattaaagttctaggcataaaatggtgaacaagataaggataatctttgattccgcatattttctgtacgctcaggaaacagacaatgaacaagcaggctaatgaaaaaaatagtttcagattgtcttaagcactatgtgggaaataaccaaggtgctgtgctagaagcaagctgttggagggagtgggaagtaattttcaaaatctttcaacaagaagcctaagaaattcctcactgggagatgacttttcagcctagacctaaaggatgagaagaaactggatgtgaaaaaaagtcaaaaaaatagatgagaaaaaagatcctgaagggtgaagcagcttccttgatttaatatgtatttttagggtgcaatgaactgggggagaggggttgaggtgagtttggaagatggaggaggaggggaggccagacccttcaagttgtggtagaaagtttgtattttattctacgtgaaaaggaaatgcttttgaagagttttaagcaacttattgacatagaccaatttaggtctacagaaaagttaagtattgtaatgagaaaaatatttgtggaatagtaaaccaatatattatttgccctaattaaacactactttttagaagcctgagcttgctctatcaagaacctagcccatctgactcaaattgtagatatttaacattacccaaagtgcagagaaggcacataaaataataattgaagaggagttttgggtagacagagaggaaaggtaatgaaaaatgtttatggtccagtgaggtctgggaagaaagtcaccaaagtggagaaaaaagcaaggagtaaaacatagagagcacagctttcacctgctcttctgaaatcccagagtcagaggtgtggagctaattgaagggaaaggtttttgcccacctctgttttgatctctgaaaagatagcttcattgtgtggtgtttgcgtcaacataggtcagccatggcacagaaaaataaaatgacgatatggcatttttaagcagagagagaatgttgagagaaggttcagagctgcccttgtgaacggggacaaggacgggactctgaagtgcccacatgtcccctggaagagatggaagagagctgagcccagagctgggaagcattcctgggatcaccctgacaagagacaaggcagtcacagtgctgaagccacagcatgaacagccttgttgggcatctaatggagggtgatttagaaaataaaagcagagcacaaccaactcctgaagtatccaatagaacaagtcaaaaatgtttgctgcagctcagaacatagcataagaatctcaggaatgaaccagatgtcggccgggcacagtggctcacacctgtaatcctagcactttgggaggctgaggcgggtagatcacctgaggtcaggagttcaagaggagcctgaccaacgtggtgaaacccggtctccactaaaaatacaaaaattagccgggtgtggtggcgcacgcctgtaatcccagctactgaggcaaaggaatcacttgaacccagaaggtggaggttgcagtgagccaatatcatgccactgcactccagcgtgggtgacagagtgagactctctctccaaaaataagtaaataaataaataaactggacctcctacagcaaagattgggaggatccaggggcccaaaggacaccccaggagtcccccatctcttctccacttctgcaagggcaagtggtccccttgtgtcccctccccacattctcatttgccactttgggacttacaagtggcaatctgtaaaacaaatccgtttcctgaaaaaaaaaaaaaattaaaccagagtgtaaaatactattaattaaccagttaaaatctccactataaattccttctctgtttgtcagggtcagggcttatgaggaagattagacttgtaagagacaaccaagaaccttcaattacttgtacatccgagttgttctaaatgtaaatttgtagcactagcacgacacttagacttaatttaattccatctattgcagttcattgactgttcatatgtaattagtacacatttaaaaatacatgcttaagatatgggtaccgctattaatgaagtgatctgaaatgaaaagtattccgaaccagagtaagaaatcatatgttctgtggctgatgctgtcactgctgccaactggccctataacctagggcaagtcatttaatttctctgggcattaattttctctggaaaatgaggagactggactaaatcattgttaaggtcaattttgatttctgatgtctgtcatgtgagtgctaaaataaggcctgctgagatgatggtggttagatttgcattaatcaagaaacaatgataataagtgtagaaccacttagtgagtccaggccatttgcctggcacaaagtaagtcattttatgtaggttatttctaatcatctaaacaaacccatgaggaaatggaagttcagagaagctgtaatttgctccatgctacacagttggtaagtgctatagccaggcttctaactcatgttttcgctaaagtttctaaattatatacaatagtacttattatccatctttttacagtgtttgatttcaagataccagcttgcaggcattattaaaatcctatatatccttcaagctcctcattctctatgaagttatttttatagcgttgaggcaaagtaaactatatcctgagctcatgaagaactctgatcattcatttagcacttttttcaaagctaacacatttttctaatctcttctaactatctcctgtgtactcccaacaaaactataaatgctctgaaggaatgccaagaaatgcttaggggggatgtagcatcaacagcggtggaactcaagtgaagagagtaaggtgcctacagtccaaacttcaaggggtatcacagtcaggatcacaccactgtgtagggtcacctcagcgcattcctggttctgtacagcccatagcagctggtggaaagctagttcactgggatgatctgaagttcaacaactttagttctcagctatgatgcctactgatttggctgccagtgaaatccaacatagtgcctgaaaaatcaacctggtgaaaacaaaactgaagttcagaaggcagagtagaggtaagccagagtagaaatgccttccttggtagcatatttgttttttgttttgttttgttttgagacggagtctctctctctcgccaggctggagtgcagtggcgcaatcttggctcactgcaacttccacctctcgggttcaagcgattctcctgcctcagcttcccaagtagctgggattacaagcacgtgccaccacgcccagctaatttttgtatttttagtggagaccgggtttcaccatgttggccaagatggtctcgatctcctgacctggtgatccgcccgccttggcctcccaaagtgctgggattacaggcatgagccatcgcacccggcctggtagcatatttttatagtataatgggtcaccaaagagctgaaacaagaaatgagaagatacattttttttcagttattccctggagctaaaagacccagtgatacaatgttgtaaatggaaagattttggaagcaactcctgtagattgacctatgtgtgttaatgccataacaaaaaatcatagactgggtgacttaaaaaacagaaatttattttctcatagttctgaaggctggaagtccaggtcaaggtgtcttcaagtttgatttcttctgagacctctgtccttggctttcagatggcggcccactctgtgtgtttacatggtcttttctctgtgctcatgcacccctggtgtccctttgagggtcagaatgtcctcttcatataaggacaccagtcagagtggattaaggcccaatttaattgtttattttaatcacctttttaaaggccttatctacaaatatagtcatattctgaggtaatgacattaggggtttaatatgaatgagtgggggccttgggaattcagtccataataccatgaatctagagaattataagctgtcacatagagagatatactcatggtggctagcagaatgccatgcatgttaataaataagtattatttatttattcatgttttaagattcaactctgacaatatctaggtaaacaataaatttttgttgaatcaatatgattgattcaatgaataaatttgtttactatcttgagtggtcaccatcacactatgtgaataacacaacttaagggttagagacttagctgagatacaagttaatatattactcccatctttcttatttaaaagttagtattttaattaaacaattgaacttaagcaatgttacaagttaagcagataaatcttatttagcaagatctttctttagtaaatatctagaattgaatatttttctcgctttttcttctttattagctttaatcagacctaattcatatacttaaaaatggaggactgaatatttactacaattaaatcctatactgatactaaatcacttttggactgaccctctggtttcagattatcataaagtaaaacatattttatttagttcagctgctgaaaaggttctgcattatgagtacttattttaagtatttactgaaagcattaggataataatggatagtcttcaatttctatttattcattgtatttttagcattacacatcctctcatcagccaaaatatctgggcctttcccctttgctccttggctctaagatcccctgattcccttttttaatatggcaataaaaggaaaaaagaaaactaattttgtagattttcttcttttacagattacaacttttttgtctagattgtttaattagatggtattttcccacttggctttaaaaataaaatagcccatcactcatcaattactatgaacaaaaatcattgtttaaacatgaaatttaaattgaatagtttacccttagctacaggccagcaacaggtgaggtcacagtgtaaacgaaggtcctcaaatatatgcttttggaaaagtatgtattcttatttattaaatttatctttgcattgtctttttacttgaaatattcgagccgcattgtaaattatgagattaaataagtatatttttatatcaaatagaatttcttaccgagtttttataagattaatttatagtagcacttagcaaatagagcttgtgtcaagtttaaaagaccacaaaagacataaacttgagtagaaataatctaatcactaattttacaggtgaaaaattaaaggccagatagtaaagctaaaatcgtaaacagaggaattatcttgaagtggctttcatttttaggttcagaaattatttgagaaatgtgttttggacagaatctttgagaaacaagtaggtgtgatcgcaggtaatcatgcataaaccaaaagcatcaataattaattcaatagaagtgagaattgagggactagtagcaggttttgcagcaaatgtgagtttgaggtttgtgtgttagaagatggggagtcagttgagaactgatatacagaaagttcaatgtgacaattacatagtttgagacaatgctggttgacaaaatggactaataatagaagagtggacctaaaaacacctgtaggaaaaggacattctttgatccatttgtaaactaacttggttttagagaaagactacagtaatgcacatgaagagaagaaagtgagtccacacaatgtagtaaagaaaaatacaacaggattgtgtcatatattcatatatatgttacaagttctaataacaatttcttgacactaaaattaatcatgttgaattttgttaaagaaaaataaattattataaagaatgtaggaaaaaggccatcaaaaaggacaaagatggttaaaaattgaaaacatcccaaatttggtaatattatttgtgtggcataaatgaactaagtcaagtcccctttcataataatgccttgggaaatacttcacagaagtggtttaaaattaataaaaggtgatggtcttaaaaaaaagaaaaaacctagtatgtgtttaattagactatgtaaaaagactttcaccttttgtactttcagtagctagccagtctcacagacagtcttatgttttagacctcagagctggtctacatgacagcacatatttgcagtgatgaaggctaggggggaaaatctcttggctttcacatatctttgtaccagagtcatttgccaacatagaaagtccatttttttattcccagtggcgtttacggtaaaggagaagcttattgtttcatagtatgcgtttgcatgttgtttggatgctaagcattccacctcagagaaccttgagatggtgggaaagctcagaatctagtcacttgaagtaggaaaacaactctgatgcagtgcccctcttctttgcgttttcctcaactgatcagacacctacggtgttttcaactccagaaatgtgaacaccaaagcaaagctaaaacatcagcagggctaaggatatgcctagttttagtctgttcttgtgcatacaatcattgactgtataacgctttctaaaaaaggaatatatcacaattaaaggctgagaaacttcgtggaaaaaagaactatcgtaattgtggttagggaaatgacttctttgcattttctaagtaactggtcccaggtcatgagattttacggcttacctaagtaaaaatattctgcatttgttaccttgtcctttttattttttagtagaaatattaatttgtaggaattagtgtcaaaattccaagaattatttgataatacactgtagttggttgaattacatttcctaaaaaacctgtgttgaaattataaacctggatacatgtgactttaaccttatttggaaatagaaacttttaagatataatcaagtcaaggtaacggcatactagattaggttaggccccaaattcaatgacttgttatctttatcgagaaagagagatttggagacacagagacacacagagggaagacagccatgtgaaaacagaggcagatgctggagtgatatagccacaagctgatgaatgccaaggattactggaaaccaccagaagctaggaagggcatggaagatttcacctctagaaacttcagaaggagcataaccctggcaacaccttgatttcagacttttagtttccagatgatgaaaaaatttatttctgctttttaaagccatccaaaatgtgatgattgtttatagtagccctagtaacctaatacactctcggaactataattctcccctgattataaattgtgtacccattgttatctttttaaaaatgttctcattgctaataaaaatatataatttcaacttttgtgtatagaaggtgttgatatgtcttttaaaacttctagtaatcttaaggatttctgtatagaatatggaaatttaaagaaaaaaaatttagtcttcttaatgaaatcaatgttgattgggtgaagacaaacatcttcattctccccttcagtctggcctcttggcctcttcctgtaagcatccaagagtaaatcatatagcttgttaccgtacagtgaatttcagagggagatgatgatgatgatgatggtgatgatgatgatggtgatgacgatgatggtgatgatgatgatgatgatggtgatgatgacggtgatgatgatgatgatgatgatggtgatgatgatgatggtgattactagaaacaggaaaattcatatcttaaattttttgtttgattgtaatttgttaacatttactggtatgtatcatgtatattatacatccacacacacaaacccctttgaataaacagtattatgtttccctttacctttgtcttagcttgagttccccagcacacaagcctgaaataaaagagtatgtgtggagtactttaaaggagtatatgagacacaagagaagcaatacatggaaggaagaagatttactataacattttatcaattagaccagtttgataggaagtttgggcaattctagagttaataatttatgataaggaagctcctctacatcttcaacaatctcaattaataaccttcaacctttctgcctgaaataacctaagctctccataatggtcactacttctcttgcagcccacccaagcagaggccacttaatctctcacaatccgtatgttataaggcctgagtgaggtcaggattcttgttccttcctttctaatatcatattcaagcacactctcctcaatttatggacccttccctttgactttcaccatcttcctgtccattccaattcctgccaatgattacagtgaattcaacattcacacaaagggctcaccaaacactaccagttcctgaactttctagtttccaaagaccttccccttaacttgaaacttgagttcagctattttctttcactgttttctcttaaccattttgtttcttgtgatagggtctcactgtgttgcccaggctggagtgcagtggcatgatcatagctcactgcaaccctgaacttctgggctcaaatgaggctcccacctcagcctttcaagtggctggaactacaggtgcatgctaccatgccaagcttaatatttatttatttatttatttatttatttatttatttatttattgtagagattaggtcttgctatgttgcccaggctagtctcaaactcctatcctcaagcaatccttctgccttggcctcccaaagtgctgggattacagggtcttgctatgttgcccaggcaagtctcaaactcctagccacaagcaatcctcctgccttggccttcctaagtgatgggattacaggaataagccaatatgactggggctcttaaccttttattttaccaatatttaaacaaccttgcctctatacctcacttgtggaagcctaaatgtggatgacctcattcatcccctgtccaagctgtttcctagaaagctgactgtcatgtttgagctgcattatgaacaggcccatgtggcaataaactagaggcagcctttaactaatagccagttaggaactgaggctcttagcccaacagccatgaagaactaaatcctgccaacagccatgtgagcaagcttggaagcagctctttccccacatgagttttaaaatgactgaaatcctggctaacaccttgattgcaatcttgtgagaagccctgagccagacatacccagataaatgtgcccagattcctgacccacaggaactgtgaagtaacaaatggtgttttttaagccactaagttttggtgtaatttgttactcagtgatagataacaaacaaagtatctctgccccctcagcaaagtcatctgtccctctggcaactggagtgtatgctagaaactaatgttttgtgattaagaaattggtaacttggaagcaatggtagaccctctaagaaagtcgtcataataaagacagaaagtagctgaagggaagtcatgtataccccatgacacaccctgtaaatgcatctaaatttctaccttccccataaagtatttgttgttgtcattgcctacttaaaagtcagctcttaaggacttggtggtctagtcaaatagtactttatgagtagaattgctctaatgcattatatgagctctttctgagttatctgagcaatttggtaatacttacttcttcctattctcatccttcccctgctcagtttaatttaataacatattcatctcattatcctgctcccaccaataggatgtatcatatctcaaatacttctttgccacattttggttttctgctattgcttacatgtactatgataatgatactaacaaaggacagtggaagggcataactttatgcaggagcagatcactattattatcctttgtttctccatgcccagagttcactgtttccatttagacaatgtaaatgttttgatttctctcttctaactttttcctaggattggcttgcactgtattttaagggcttatatttggaatctctctttaaaatattatagttcaaccaatttatatatcagtctattgatctcatagcataattacagcatagcatacgtatggcactagttcaatcagtgacatccataaaacattgatatagtataggtattaatagcatgaatgagttactctgtctctcagtgtctcagtttactgctatgtcaaatggggttgataatcatttacttcatacagagattgagaggattaaatgagttaaatacttaaatcacttagaacagtgactagcacatagaaaggcattaagtgtttgctgcatgtaccaaatataaactttccacaaataggattattaaattttataaacaatttctatatttctaaatacattatctcacctgatgatgacaaaaaaccattgagtaagaaatggcaaaggttattgtattcattttacagataaagacacacaggttaaaaaataaataaataccaacatcaaaactcctcagtgtcagggccaacatatgaatctagattttcttctggaaacttttctgaagcttcttctgcctgctttagagaggtcaagaggtgccaacatatgatcttattcatgaggactcaatgagtcgtgattttcctaccctccaccagcacatagccagctcagtctttccactggggaacatggtggggtgtgtgtgtgtgtgtgtgtgtgtgtgtgtgtgtgtgtgtgtgtgttcattatgggaattcaacaaagagttgatgtgaatatttgtgaagacagaaaaaattgccatgagatttggaattccctttgggcaatcatcatattgtagctccttaagcatggaatgatgtacatccatttcctggtggaggttgtggggtattttttttttccaatatcagacagtaacatagtaatttgtggccaatactcagggatgttggaataaagatgctcaggacaacacttatcaggctttcttgaaagtgtagttttgttttatgtttgttttaagagaagaaaatttccagtctcaccatttgatagagtaaaataaaacccataaaataaagcacaatgtacatttcctatttttacagcacttgagtggtgtttctggtttgaacataagctaatgcattgttttagctgtacaaaaatgcaataacacaaaagaaagagcttgtactaatggaagtgagtaagccacgtattaatcagtccacctagggacttaaatccctttgttctcactcccactaagtaagtgcagcattgccaagagtcataggtataacagttataaaatatcagaatacgataattttttaaaatatccaaaacctgtttttaatgtctggatttaatgtattttatattttacttttttattttttatagcaagtcattgtcagcagagagctatcaggtcgtagtgttttatctgtaacaccggtgaaagctccgcctcctacttctggcttgtgagagtttctttcctttggggtggtggctggtgccagaatgagaggaaatatcatgccccccgagagtcaagagcagctggtgcagttgtcctggtgtttatgggatattataggcataaaggcacatttggaactggttgaggaaagaacttaatgcttctttcttttatctttataatccactttcctagcaaggattatcctgccgttcatactaaatttagcaaatgcagattaaagaaaaaaaaaagctatgttgccacaaggtgctgtgagaatgcaatgcatgtgttagatagataaaccgacttttatcaaatgaaacaataaagacacaaagaaacttgttcaaactggttttttttttctttgaacaatgaaagacatttttgtaagaattaaccagagggagttgtacatctggaaagcggtgaacacatagcttctatttgggagaaaactaacattattgccaaaaaattatccatctgtagtatgatccaaatttgtcaagctaggagtgtcatagacagaaatttgctaccagaaatttgcattagatagtattttcactatttatttttgatgacatctttttttgtttgggcagaatttttatggtgtgtatttagtgaagagctacagaaccttaataaaataaaatagtaaagcatcagcatggcaaaactagggtcacaatggtgacttttaaaaaatttccctacagaaatcaggtctcaggcactttttgcaagtcacagaaattattccttagtgttgggttgtcggctgttttatattcttacccttcccattattccttattattttttctggaacacttggggttccatcgtccaccttctcaatgaacatcagcattgtgactattatagggcattcacgtctgctttattcatttattaaatgattaatttaggaaacagtgagaagtgactctggtccacagatttaggaaggccctggaaatacaaagatgaatacgtgtccggttaacatagcagagtgaacttttcctccaaaacatagaaatgctgtataaatgagaactattaaatattatatggttgaactcaaagaaaaaaactttaagaagttgtcacatgcgggaaacaaagagcacaaagccaatgcattaagatagcgctgaactcaaggtgggcttactgatttccaacaattatttaaactttaaggggtgagagcacaggtttgattcccaaataagggttcaagatgagcccctcatatcttgaaaggcacaaagccttcatataaactcagaaactatggacataatctggtcattctcctggaatatggcatggaattgttccttctacacataactcggtggttgttgggggagagtgacctatcagaaattggaacccaagcctacccacatgtaactaaatttgaatttttacttgcggtgtgttgagagtaaattttgcctcctcacagaggcaaactggaaaagtatgtgtgtacttgcatccaaaatacaaggtacttgcagaaaagacaatgcctactagaaataattataccatcagaaatcactaaaagttaccctaatgaagtagacacctatgatagggtcaatagatgcactaaagataaggcaactggaattccttcataatatttgacacttaatgtgttatgtggaataatgttttaaatttttgcaccaatattttaatcttttctcaattttttctttaaaaatatgtagactcttaattctcattcctacatatgtctatcccatggcttgaattgaacttcagttaaagaaatgttgtcaaattctggaatttaagaaagatttcatatttgtttgattactcattctctcaacaaatattatagagagctatggtgtatcaagcactgtgcaacatgttaaagatacagcacttaaaaagacagtgttaatgtggctaaagtggtaagtgaagcctatgagacagggagaaaggtcaacaggtagttataattcagcaagataaattaatgacataaacaacacagcacacattgcttttgaactaacttcacttttacaaactgggaaaggtgttgggtttgccctggtcaagtttttgaatttaatgtgttaaaaaaaaacattttatggcatacgaataaaataagaattctcctgaatagaaatcactggtcaaattaccctcacattatgttctacaaaaaaaactccagaatatatggcaatgtctaagaatccttgataaagaatatggcatgacccaaaatttcatacacctaaattttcaaccttatggaaaattaatgaaaagacaactttacatatttgagacctgagaaagtatatgcgatactacccaatgaaaaaagttaataaaaaagcacattgcagttcaaccaatgataaaccaaaataatgaattaaaaaaatgcattataaaaagatgtgattccaaagaaaatatagtttccgaacaaaaagaaagtattaaaaatcattcccaaagaggaaaatatactctctaaaataaaattagcaagaataatcagggatatttgactcttgatatatcaacatattgatcagtaagaatgagctccttaataaacgtagcaaaaaggaagccaaaaagaaaatggttggtcttaccttaagtaagattggcataatacgaagctctgttcaacataagaaatactttggcaacaacagtgataagagctcatggaaccaaaattacataaaatgaccgcaaattcatttttttaagcatttttttttgctaatttgcagaatgattatattttatctacaaatttccaatttaatttaattgctgaggtcttttaggccaaaaatactacctgatcaacttttctaaaatttatcttgtctatgataaaatgtttattatgcatgttaaaaatacttaaattctacctgacataaaagttgttaatgaatatttacttcttttactatcttctctgtgtgttttattagaaagtaccacaaataaacctcaaagactactttgagcagtatcaacaggttcattaaatttggaacaagaagatggaaatgacctaaaagatagccatcaatagtttaaaataagtggtcaatattttcccacagaacactggtaaaaattaaaacacattcactgtccatttatgcagtgtatattattatattcatgttttgtttattagaaaagtcaaaagattgaagaaagtcaagtttgtaatggaaattttaatggaatcttagagtaaaggtaaagtagttgtggaaaaataattcttaccagtaggaaaaataatctaggtaaaaataactgtcaacgtgaaccaaaatttaaaagttgttttcttcatttatagaaaggagaaatcaaccatttctgtaattttgacaatataactgaagaatgagctgtgtttcaaaattataaatgtaaactctaggagaattaatacggactatttactttttaaatcaccaaggaataaaaaatgaacaggaaaaaaggaagaatgtaagatagaaaataatgaataaaataaacaatggtgacttagaaatctgaaaataaaaataataaacaccatacttttcattattatttagttagtttttaatttcaacatttattttagaggtgggggtacatatgcagatttgttacattggcatattgtgtgatgctgaggtttgcggtatgattgatcccatcaccccggtagtaagcataatacccaacaggtagtttttcagtccttgccctgctccctctctctccccttttggggtccccagtgtctatcattcccatctttatgtctacatacacccaatgtttagctctcacttataagtgaaatcacgtggtatttaattttctgtttcagctttaatttgctgaggataatggcctccagctctaccagtgtttctgtaatggacatgattctgctctttttgtggctctatataattttgtggtgtatatgtactacattatctttatccagtccacaatggataggcatctaggttgatttcaagtctttgccattgtgaatagtcctgtgattaatatgttagtttggtgcatctttttggcagaataatttattctcctttgggtatacacccagcaatgggattgctaggttgaatgataatttcattttaagtttttgagatatctccagactgctttccacagtggctgaactaatttacattcccaccaatagtgtataagaattcccttttctccataccttcccagcgtctattattttttgataacagctattctgactgatatgagatggtatctcgttgtggttttaatttgcatttatctgatgattaatgatgtggagtatttttcagatgttcctaggacatttgtatgtcttcttttgagaagtgtctgttcatgtctttagtccactttttaatgggcttatttgcttttagcttgttgaattaagttccttgtagattctggatattagaccctattcagatgcataacttgcaaatatttctcccaatgtatttggtatctgtttcctctgttgatagtttcttttgttgtgcagaatctctattttaattaggcaccccttgtcaatttttgtttttgtgtcctttaaggtcatagccataaattatttgccaaggctgatctctagaatggcatttcttaagctttttctaggattcatatagcttgaggttttatatttaaattcttaatctatcttgagctaacttttgcatatgatgaaaggtagaggtccagttttagtcttctgcatatggctggtcagtcatctcagcatcatttattgaatagggcgtcctttctccgttgcttacttttgtcaactttgttgaagatcagatggcagtaggcatgcggctttatttctgagttatttattccattccatcagtccatgtgcctgtttttctgtttgtttggtttgttttcgtatatttttatcagtatcatgctgttgtgaatactgttcccttataatattgtatgaagtcaggtaatatgataccttcaggctttgttctttttgcttagaaatgccttggtggcctggcgtgtggctcatgcctgtaatcccagcactttgggaggccaaggcgagtggatcgcctgaggtcaggagttcaagaccagtctggccaacgtggtgaaaccctatctctactaaaagtacaaaaaaaaaatttagcagggcatggtggcaggtgcctgtaatcccaggtacttcaggaagctgaagcaggagaatcgcttgaacccagaaggcggaggttgcagtgatccaggattgcaccattgcactccaggcatgggcgacaagagcaaaactctgtctcaaaaaagaaaaaaaaaaaagaaaagaaagaaagaaatgccttggctatttaggctcttttttggttccatgtgaatttatgaattttaaaatagttttttttaattctgtgaaaaatgacattggtagtttgatagaaacagccttaaatctgtagattgctttgggcagtatgaccattttaatgatattgattcttccaatccatgagcattagatgtttttctctttgtgtttgtcatccgtgattactttcagcagtgttttctagttctccttgtaaagatcttttatctccttggttaaatatattcctaggaattttatatggttattgtaaatggaattggcttcttgatttggctcaatgtttggatgtcattggtgtgtagaaatgctactgatttttatagattggttttgtaccctgagactttactgaagttatttaatagttccaggagactttcagaagagtctttagagttttctaggtatggaattacatagtctgtgaggaaagacagttttactcctttttttcctatttgcatcccttttgtttctttgtctggctagaacttctagtactatgttgaataggagtggtgagagaaggtatccttgtctttttccagttttcaaggggaatggttcaagcttttgcccattctgtatgatgttggctgcaggtttgtcatagatgctcttattattttgagctatgcttctttgatgcctaatctgttgagggtttttatcattaaaggatgttagattttacagaaagctttttctgtgtctattgagatgttcatatggtttttgcttttgattctgtttatgtagtgattcacatttactgatttgtgtattttgaaccggtcttgcaacccagtattaaagcctacttgactgtggtgtactaatttttgatgtactgatggatttggcttgataatattttgttgagtttttttttgtttgtttgtttgtttgttttttgttttttttttttgcgtctctgttcaacacagatactggcctgtagttttgtttttgttgttgtgtttttgcactatttttgtttcagggtgatgttaactttatagcctgagttagaaaagagtgcctcctccttgcttttttggaccacttttagtagaattggtagcaacttttctttgtatgtttggtagaatttggcagtgaatctgtctggtccagggcttctttttagttgttatgattttaattacaaatttaattttggaactctatattggtctattcggggtctgaatttattcatgaatctatttaaggaagtttcatatatcaagaaatttatccatttcctctagatgtcctagtttgtgtgcatagagatgttcataatagtcactgaggatcatttcatttctgtagaatcaattttaatgctacccttgtcatttatgattgtgttttttatcttctctctctttttctttgttagtctagctagcagtctatcgatcttgttcatcttttcaaagaaccaatttttggttttgttgattctttgtatgaatttctgggtctcagtttcattcagttctcccctggtgttaattatttcttttcttctgctagctttgagattagctctttcttgttttctctacttactacagttttgatcttagatcattgatttgagatctttctaacttctcgatacaggtgtttagcagcacaaactttcctcttactactgcatttgctgcattctggagattttggtatgttgtatttttattttttatttcaaagaattttttggatatctaacttcatttcatttttcatacaaaaattattcaggagcaagttgtttaatttctgtgttgtgtcgttttgagagttcttcttggtttgatttctgtttttcttccactgtggtccaagagtatgtttggtatgattttgatcttcttgaatatattgagtcttgctttatggctgagcatgtacttgatcttagagtatgtcctgtggacagacgagaagaatgtatattctgtggtgcctgggggaagtattctgtagatgtctattaggtctacttagtcaaatgttgcgtttaattccagaatttgttggtttttggcctctatgatctgtctcatgctgtcacttgggagttgaaatccccccacaatgattgtgtggctgtctaagtctttttgtagatctaaaaggaatttttaaatgaatctcgttgctgcattgttgggtgcatatatatttaagatagttaagtctccttgttgaatcgaatcgtttattattatgtgatgctgatatggtttggctctgtttccccacccaaatatcatgtcaaattgtaatacccagtgttggaggaggggcttatgagaggtgattgaatcatgggggcagacttcccccttcatgttcttgtgatagtgagttcttggaaatcttgttgcttaaaagtgaatagaacttccccctttgctctctcttcctcctgctctgaccatgtgaagatgtacctgctgcccctttgtcttctggcatgattgtaagtttcctgaggcctccccagtcacgcttcttgtacagcctatggaactgttagtcaattaaacctcttttatttataaagtacccagtctcaggtaattctttatggcaatgcaagaacagactaatacaaattcccttctttattcgtttttactattgttgatttaagtatattttatctgatataagaatagtgattcttgctctcttttgattttcatttgcctggtagatttttctttggcctatggatgccattacatgtgagatgtacatcttgaggatagcagatagattggtcttgttgttgttttaatccaccttgccactgtgtgccttttaagtgaagtgtttagactatttgcattcaaggttaatattgatatgtaagtttttgatcctattgtgaagtgttaatttctggttctggttgctttgtaatttctattgtgtagttgctgtattgggtctgtgagctctggtattgggttgatggtagcagatattgttctttcttttccatgtttcaaactccctttaggatctcttgtaaggccagcctagtggtaacaaattctcttaatgcttgcttgtctgagaaagattttttctcctggagttatgaaacttagtttggcaggatatgaaattcttggttgctgtttcctttctttaaaaatgataaaaatatgcccccaatctcttctgccttgtagggtttctgctgaaaagttaactgttagcccaatggtgttctttttgtatgtaatctgccttttttctggcttcctttaagattttcttttttagtgttgatttagagtagtctgatgatgactgtatgccttgatgatgctcattttgtataataccttgcaggtgttctctgtatttcttgtacctgggtgtctatatctctagcaagattaggaaaattgtattgaattattccctcaaacatgttttccagtttgttaatttttttgttcctctctcccaggactggcaatgatttatagacttcgactttttgcatgagtctttttacaaagtcttcttgaagactttgtttatttttttaaaacattctctttattttcggccaggcacagtggctcatgcctgtaatcccagcacttttggaggccgaggtgggccgatcacgaggtcaggagatcaagaccatcctggctaacatggtgaaaccccgtctctactaaaaatacaaaaaaattagccgggcatggtgggtggtgggcgcctgtggtcccagctactcgggaggctgaggcaggagaatggcgtgaacccaggagatggagcttgcagtgagccaacattgcatcactgcactccagcctgggcgacagagggaaactccatcaaaaaaaaaaaaaaatctcttcatttttgtccaactaggttagtttgaaagattgtgaaagactgttcttcaagatctgaaattctttcttctgcttggtctagtctattgattaggcatttgactgtattttaatattccttaagtgaatttttcaatttcagaagttctgattgatttttaaaggtgtttatctcttccttcattttctgaattgttttagtagtttctttgtattgattttcaatcttgtcttgaatatcattgatttttctggtaatccgtgctttgaattccttatctgacacttccgagtttctattttggtttcagaccattactagagagctactgtgatcctttgctggtatcacagcattcagatttttcgtggtgctaggatttttacactggtttcttctcatttggagatgctggcacttcaattttttgtaattgttgtaatgcacatagaattttttttctttctcaatattattgttttttttcctttcatttttctctcccttgctagagagtgtaactgtaaagtatgttgtgtagggtcttttcagtttgcttctatggtcctatgcatttctgtccacaggttttatattggtctggttttatacaggtcaaccctcaagccagtaaaaaagcagtagataaactaacctgtaggttgaactgtaaagtccaatacaattgggtgcttacaggtgagggccagcaatagcacaagcagatgaatatgtatctggtgttgtttttactgttaggtactttctgttgtttcaggcgatgggctggaccttggagtacttggtgccgtgtgctttctattccataggagttggggaacacagcttgtagcatgatttttttttgtaaaagcagtgggagaggctctgcctttgggcatttgctgcagtgtgttggtcatggtgatgtcagttggttgggtctgtccaagctcaggcctcctggaggaaatggtcaggtgccagcagaattggaatggagtaggtacttctctaactccctagcccctagaaggcctgttggacagcatgcatgagtcccgatggggctggatgggagggaaagtggcttaggtgatggctgtgaagggaaggagtgggctggtcactaggtcaccggctcaactatcaggtggggagaaacagagcacataggcagagggagcgagagggaagatcacaggcctataggagtaaggtttttcagaaggcctctaggccacagccaaaatgcccagtagaggggcaagggttgagtgcgctggaagtcagagggcagaaaggcctgtttgggaagaagcagcaggggcaggggcacactgaaagcggtcttgatgcctcttcagaggatggctgctggtatgcttgaggcttgcaaaagtgttcaggctttttgttccctccccagtctgggggcagcaggataagggactacagcaactgcaatggcagaggacttatcagttgcctctgggagatacaccccagagaaatgcagagcctccaaccaattggagtaatcagatgggggtggtatggctgtgctagagtcccaggccagtgggccttgcctggcaaggaggagtggaggtggagcttgcagtctctccctcctcagcaccatggttggagcccctatcccaggggcatgtaagagagtctgtccttccttgttggtagggctatggcagctggcactggggttctcagagatcccaggcccatgggtttccttatgggcttgggcagtagttctgcccagacacaaagcagatctctgtgtcagtgtggaggcctggggaggggtcaggggatatctcctatgcctaggattacaaaggtctgtggtggaattatgagtccctgaggctcttcctcactgaccctttccccaatgtggggagcttcccctggttctgcaccagtcagtcctagatggatggctatcctgctttgctcctctctgctctccatgggtccctttgcttccttgataaatcccggtgtggccttttggattatcgacctgaacagctagtgttcacttgccattttgtttccttttcaatagagtggcatgcaccagctgcttcttgtcagccatcttgaaatctctacattctttactattacagtgaagcacattaaaataattcctcatccacaatatattgcatttaccttaagtacatatgcctagttatgggtgtttttagagtttatagagcaggatacttttctggcccttataaatgttattatataaaggttttgagaagatgattagctcactctattaaaagagagaaaaatatgtagatgtaatgggttattacattcaaattaagttcaaattatttcattatgatttatgatttaacttgtgttatgcagtgattcaatagcttttcttattttgtgcctagattcattatattatttgttataatcaaataatatttattcaattttataaaagctgtcattataacatcatattgagtaaactgccatgtgcagacattaaaacagtcaaagcagacttattagttgcaaagtatctttctagttaatgagcactgatttcccttttcagtgaaaaataaaaccaaaatgtgatacagatgaaaggtacttgcttccaaaccaggatgagagttcaagagattgtatagattttcaatatgtgtaaaggaaaagccgctttcaacttacaataaactaaatctggaaaataacttgaaatgaggttgtaatgtgaccactatcctttaagctataccttcctgagtgttgtgctccctcttgccatataggatctttgcacagcccgcttcttgtgcctgagggacaattttcctctacttcatttgttcaatctctaccatttctttaggtctcagtcatatgtcaaaaattcattccttagggaagtttccttgacctctttaagaaagtctatttctccttttatgctttctgcacaccattttatttattcgacaaatatctaccatacttaattgaaaccaagacactgctgatggtaagacttattttattttattttattttattttatgtgtagtcactaggaaagacaaggagatgctaattaaatgatggcacaatgttttatagtattcagaatttttattttacttttattgaaagagctttctttgaaatatttagacatagatttctaccatatatccatcttatgcatatataaaagggaaatttgatatgaaataaagatatttctaaaatatttacattcagaatacaacttttcctagtttagttcaactcaaagcagtcaatatctatgtattttatataatatattatttaaactataaaaagcattggtaatgtacttctcaaaaatttgcttcaagttcaaagtcagttactttcttttgagagtttgctgcaatcttcttcttcgtagaaggtttacataggtactttactaatttttaccacaaagtttcaaattaaggttttctgatatgatcagaacttctaatttcttcctcaaatgaactttgaagtgtttgatcaagccaccaaaaatatacaaccaagatcaaccatgtgtagataatgcaacctatcacaccttagctaagtgaatgtaccatattactgattatagtagcccaatatccaaaatgttaaactataccttttagattgatgaaatgtgctgtgtagatgtcaatgcatcaagccctactttaagcactttatgagtattagctgtttaaatcttcataacaacacaatgaggtaggtacgattattattcccatttcctatgtgagaaatcagaaacatttctgaggttaagtaacttgctgaacttaatacatccaggaagtgatagaatcatttacacagttgtaaacttgtatatcacctataactaaaaccaagttgtaatttatacttgctgctttaaaaaattaattttttccatggccacattgtaaatgcaatgagaacatggaacaaaacacagtgcttaacacaaactgaaagctcgacaggtatttattgtagagtgagtatgaagagtctctgcagcatcttctctaaacttagcatctttccttccctgttccttcctcttaactttgacttttgcagtgtagtcttatgactataagagtcatatgtctcttatagtcatatgtctataaaagaatatgttttctcttatgtggtataattttatgaaagtcaaaagatttttcacttgaaattatcttccttaatgattagtggaaatccacaattagtgattcatacttttgtgtttgactttttttttcttgaaggtattctttttagatgtaaatatatgagaggtataacatggtaaataatattgtgtaaatttatttgacttgtctgtcctgttgataaaaaatgggtttaacatgaggactcaagatgctttctgtgggaatcagtatgaatttggtaaaactggaagggttaaaatcaaatttcaccaaaaccagattgttttaaatttttattgaagtataacagacatatagaaaagtgtacctatcataagtgtacaagctggtgcattttcataaagtaaacaaaccttaaccaaacacaggatagtattgccgtctagaatctcttgttactaaccctgcaacaactaccactttctgacttcttttatcactgattagttttacctgcttttgaacatcatacaagtagaatcctaaagtatataatcttttgtgtacgacttccttcactaaatttatatctgtgagatttgcttattttttcatgtagttatagctcatttattctcattgctgtactgtattccattgcaataaacatatcacaattaatttacacattttaccgttgatgaggattttccagtttggggcttggcaaacaacactgctataaatcttttttgcaccttttgataaaaagtaagcaataacttcttctggttatatgcttagtagtagaatctgggggttatataatatgagaaacgttcagcattagtagatactaacaaatattttacaaatagattgtactatttgtcttttagttttttttttaagaagcacccatcctggtaatcttacctaatctagaatgactttcatgacacactgactcctttatacaacatatacatattgagaaccttccatgtgcaaataattattaatagcaaactttatgcttttgtattaaaaatatgcttatatattcatttccccttgatctcacataattgttttaaaataggtggtagagacattatcattctttcttatagttagattatgaggctcagggaggttagatgatctgccattcacaactggtgaatggtgatgtctatacgtgaacccaaaagttctttttttttttttttttgagatgcagtctcactctgttgcccaggctggagtgcagtggcacaatcttggctcactgcaaccttcacctcccgggttcaagcgattctcctgcctcagtcttctgagtagctgagattacaggcaacctctaccacacccggctaatttttgtatttttagtagagatggggtttcactatcttggccaggctggtcttgaactcctaacctcaggtgatccacccacctaggcctcccaaagtgctgggattacaggtgtgagccatcgcgcctggcctaaaagttctgacaacaaattctatgattgttctactttgtcatgtcacttcattgtacgaattcaacaattttttttctgtcaatccacttgtcagttgtagaacagttaaagacatggtacttcagagattattttggcaatcacacctactccatcatgctatcagggaggtgacttctattcattgctttttatcattttattaatggggtagctgggtacaggagcagttcagggctttcctttctgagcatgccatgaagtaacctagaggtaaaaggaggcttaacttttctagatgtccctgggaaaagccagaggaaacaggaagggaaatggagtcagcattgttgaacccgttcagttttgttgtttctgacaaccccttatccgacagactctcttatacctcatctaattttataaatcgataatcattttatcatctggaacaaaagaaactttgactaataaaatttagtctcattggcgaaatggttctgtttcaataggttgtataagggaaaagacagataaatatgaataaataattattttcactctaatattgacatagtataaatacattaagtcaaatatcactgcacacacacacaaaaatccagttgttaattatttatataaagaaaaaattcaagacaaaatgtaccttttatgacatacacatttacgtcagagtacttagattaatttagggtactgaatgacaggctttaattgcacacaaaagtactggaacaatcttttgtttctttatttacttctattataaaatgtctttgtagacttagccattaacattttctgctttctcaaggaaaagataatttacccacttaaagatattagactcttgtgtattgtttttctccatttggtacccttgattcctcctctgaacacttgagtgcttgcaaacagggcacaatgacactcactaataacaactgaaccactgcacccgccataatgctgtgcagctcccagactcaccaccgccgagccccagcaatgtggaacggcgtccctgtgcagaggctggctcccctccacagctgcatctgttccccattctcccctcagagcatccactgtgaagcataacccctgatgaacacatgtagaccaaaacttggtcgtattttccccctgaaattctcagatcctaaaattctagttctttatttctaatacttagacaccacgagccattgaaacaattctgtggttcagaagaaatcatgttcattttattttcattaaaagcattttccactgacagaaacagttgaaagaggctggtctgacttttgtgacatacaaaatatatttttatttttgtgataggtggtgaagaaattgaatctttaatacagacgatatgaatgcaaagattgtccattttgggggagctgtgacaccccctcaattgtattctttttcaatgcctagcttcatccccatagtcaagcttgtcttgttttatcttaattgtacaagaattaaaaatatttggccatcgaggatcaaaagacagcatgatccccttgaaatatttggagataatccagtaagtcataaatcagaattttttaaccaaactaaatcatgaagaaaggatggaattttctcccacaaacaatggaataatcagatttctagtgactgttttgactctttaggggcagattatattgagcccagggacagcattcatggaactatattatggctgggctctctcaccactgtaatcttacatagctctttagaaattgtaacagtgtaacatgggagattccgggaagaaagaaatccatctttgttctttaaaaaataatccatctttttgttctctccagtcaatagctctaatgttttattggcccaacaaaattcacatctgtgtatagtctcctttttttctcaagtattatccaacatacttgatcgtctagtctataaaccctctgagaacagtgggcatcacttatacaatccagcagtgactgatgcagcagcaaagtatgcagaaaatatccattgaataagtgaatgattaaaagcatgaattacaggattttccatatgcttagactagacatttaccttaggaatgtctattattttaatgccaaaatgtgaggtatgtataatttaaatcattttttgaagcatgagtttccagttgtcatctcacaatggcctgcaaagacagacagatgtctgcactgtgctaagaataatccccgatttacctttggtcttttgctcacctcctctctcactaacaaggtaagtgaactaagagctggagtctatttcacactatgtgggtctggattagcactgagcttttgttggcatggttttgttttgtaaaagatactagtagggatgaaacagaagtagaatactgcaggaccttcctactctttctctttgagttctttcaatttcccttttctccgggttatttgtaatacctgtcaccatgagcagatttaccagcaacaaccttcaccatccagaaaaaccaggtttctgactctttccactgcataccaaatatcactgacatttctcttaagcattaacagtcagctttctgcgtctgtgtggtgtatctgccctccctcctcccctgcttttaatagtagaaattaggtataaagctcagtgtttatattaacttcatcattacctctcagaggagtcagatgatcagtcaactaacatataaagggagcagaatgtctttggggacaagatataatattaattactggggtgtacttcctgttccctttgtaatatccatatgcagcccttgtcaagtgcctctactggagcctggagggatgctcatcactctgcaagcaggaatttggctgagattaccatctacatagtcagaaaagcctctcagcagcagaagggctatttgtgtgtgcagtttcctgcacatgggctgtgggttacctgtgagcatcagccagttaaggccacatgccagtgaggagactcaagtcttcacttccttccacagatgggtatagacacagatctgaaacacaggggatttgaagcatgcagggctgtaccaacaaagataacggtccctcacaaataactgagccctctccaggcagctcaagccaacaatacgttttatgtgtctttcatttttataaggcactggcgagttctaaaaaaaagaaagaaagaaagaaagaaaaaacaactggcaaaacagagaagaggccatgcaaagctacagaacagcagcttgatgcttctcccaaataggcaagcagagctttaaatcactgcaaagcttgctatttacttatttcatttgttttctgttcgaatttgcccaaaatattgacccagcaaaggaagtgactggagagcacaagtcaggctttctcattagctctttctaaatcttcatggccctacaaaaatctttatttgtgtgttctgaaaatggcaagagatacgtattgtatattcaaataatatagcagtaaaaccaagattcgagggttgttaatctcaaacatattatgggattgcagcgcaactaaggtactgagtgtctccattttaattaccagggttggcagaggaatccaattatgttgctgtgtccccaacataaccctttctctttgttttctgcttgcctattctaagcatgttttgatcacctttgtttatttttttgtttgctgcattttattttctactatgcagttctcctgttctaatttgagacatatttttggaggttttattctcatcaagagttgctcatcatcctcttgcaagcataaaatgtttcatgttaagaatttttttttcttttatcattccctagtggaattgaggcaatgaggatgactggcttcccatatgtgccagaccattgtttgaatctggtggttataggcatgggttgcacaaattaatctatcgctgagcttctgacatcactgggaaatttcagactagaagcaaatttttttccactcgaattcttagtatataagtaagaaaaaatgcatggcctttctgcttttaaaatatttcacaccctattacctataagatctcaggatagagaaaaatattacacatttttcaatcaaaattatcactcatattcatagttggccacagtcattgtctgcatagattaaggacaaatcaatcactaagttctttccattctactctcctttatctctggaatccactctttcattcctgttccttactgcgactaccctcgttcttctctaaatattttaataatttcctgactattctctgtttccactctctctttgctctctccctcactaccacttacacgctaaaagcacacacatggccatcttaatttccttctgaaaaatcttacatggttttctgctacccacacactattattcattctcttcattgaacattcaacatttctctggcctgccaccaagctaacatttctaccaacaggcttattttctcatatgctgcacttctgtcgaactgcattattgaccctgcttaaatataaaatatgcttttatatcactgctttaaaaaatttcctgtgctctataattagccaagaatctagtctttcttccattttcatatattacaatctcatctttcaggattaagcacaattattactattgtcctactcatagtcattgaagtctctgccacaatacttttttataacataacattttgtacttgttttgtcttcattacgtaaatatttatctcctctacagcttatagtctgtggtctatgttttacacgttgtatctcttcagttgccttaggactgtggccttcatacaggtgctcattctttcattcaacaaatacgtattgagttactcagtaacagatgctatgctaaatgctgaggatgtagcagtgaatttaacacacttgtgcttgaaatatatattctattgaagaaaaacaagtaaacgaaagaaattagtaaatatatgagctatggaagaaagcaagcctgggaaagcagtataaaaattaagaagggtgcccctgtactccagcctgcttgacagactcagaccttgtctcaaaaaaaacaaaaaattgagaagggtggaatataattattgataggctggccagggaaggagacattttagaaagtaagacgcctgtagaaagtgggagaaaaggtcactagggagggacattgcaagctgatgggttagcatgtacaaaagctctatgaaggagctgctaatggtgaaagagaaaggaggagaagggtaggagaagaggtgaaatcatacagtgagttgggtatacagtagtaagcaatcataaagtactctgtagttaattgtaagaacactggttttaatctaaataatatggcagattatggaaggtttgagccgtaaaggaaaattatatcaattatgttttagagcctcacaccagcttctgccattagaacggattgaaggaggccaagagtgggaccagtgagaacaattgcaattttatgaagatttggaccagggcgatgtagtgggtgtggtgagttctggaacaaactgtataggatccttattaatcttctttctagccaatagtatgaaggcataagaaaaggttagatatacactccatggtcttgaaaataagtgagggactccttgcctattataacgatgccctgaatgacaaagttaactaattattatacagtgtgacctaaatcaaattaagatgacaagaagaaagttgagaagaaggattaagaggaatagaaagggggagggggatgagaaaaagaagagcctttccaactctttttgcactgacccaagagttccacttattcaagactggatatagttaatagtagaatatagtgcatggcaaatttatatagcttctttaatggattgttttcttcagatttttttatcctccaagaacaagcttcttaaaagaaaaggtaaattactttgattttatccttacaactaagagttttttttttttaaagttttaggatgtagaaattatctttccttggctgctcatcaattctgtcatatgtttatcaataaaaacacaagtcttaataagcacctactgcatacaagacatcattctccacatttaaggcagtcttacaggatactacaatgcagttgggaagtcaaattattacatgtgttctaaatagggttatggttcaattattaatgattaaaagagaaaacaaaaaataaacaatatataaccaactagttgtttcttatatgcagaaaagaaaacttactgtttctaaataaggaccacctattgtgttgatgtaattaatataatagtaaagattttattgaagaatgagtatagattagatagaatgagaaaaaggagtccaggtgtagatgaggtataaataagttcaaggaggagtgtttaagtaataaatgatctagaatggatcacataggtgggaataggagaaaaagaagactgtaaagaaggtttagctctaataattacggattttacatccaagtgaataaagcataaagttggacattagccaagggaacatgaagagctgctaaaagtttttagaaagtataagaagaaagttgaaatgatgaaagcttcattttatttttatatatttttccctttatttttaattaacatattaaacaggcacatacttactgtatacagaataatgctttgaaatatgtatacattgtggaatggctaaataaagctaatcagcatacacattacctcacatattaatcattctttgtagtgagaacacttaaaatatattctcttagacatttttaaatatgtgatacattttaataactgtagccaccatgttgtgcaatagctctcttgaacatattcccccaggtagctaccattttactctctgcttctatgagttcaactttataaaagcttcactttataaagatcaacaaggaagccatgtaaaaaatggattggaggggagaggaagttctgagaccacataaaattaaatgttgacaattctgagacctcactaagagtctaactatatatgtctataagtctcctgtcttatataatgctcctgcacttctcttttaacatctacattggtattccattgcaatcataaatgaaatgaacaacatccgggctgaatcaataccactattccatttgtaggccacatacttttttttttttttttttggacagagtctcgctctgttgtgtagaccacatacttggcatataactttgattaaacagttgctttgtcatctcaaagccagtaaataaaagttagcacaacatttatgatagagctttcctgtcattttataatcttggataaaaccacaaagcttataatattgggtgctaagtattccacaatccaaagagaggtactacattcattatggtgtggccagataaaagaaagctgaactggctccgtactattttttacttgcaacctataaagatcaaggctacagatgtattggtgagaagagcgtttcctgaagtgaggaaatgtaggtgtaaagaccgctgtcaggattttcctccgctcctgcagatggccctatggcaaatctgaaggctctaaaaaacccttggaaattgagacaaattggagtcaagaagaaactgactttttactccttagctgcagaaaaccagaaatgggcctcatgcttctaccagggtggggagcgttgtgatatcttagcagagcttgttctgtcacccctggagttttgacagcaaagagagactgcagcctggatttcataatataagtctgaagctgggaggaggcttggaacacccatacaaagagcagaaaggccacagtagaaacaggctaaaattctacaatttgacaaacaaggaagtttgaggtcctttgaaccaagtgggtactgtggaagttagctaggatgaggtcattctgaaagtactaccctacttacccccttataaaaaaattatgacttgccatggtgaagactttgtgtgatgttctgtcagaggtactagttgagaacaaactccaaaaggtcaattcaagattatcacattatcgtcagagaatatgtaatattgaaaggcactgtggggtagatagacaagggtgatccataaaaattctaacagcacatacttcataaaagtttgaaagtcttcatgtctgccatgacagaggggaataatctgccagttattgctacctaagaattgccaatagttccacctaataaaaaagaacatttctttcttctccttttaatcttcttcattatgtttggtttttggaagaaccatgaagatgagaaggaagagtggcctacataacagagcgagactgtgtctcaaaaaaaaaaaaaaatgtatgtggcctacaaatggaatcgtggtattgattcagcctggatgttgttcatttcatttatgattgcaatggaataccaatgtaggcattaataaagaagtgcaggagcattatataagacaggagacttatagacccatatagttagactcttagtgaggtctcaaaattgtcaacatttaattttatgtggtctcagaacttcctctcgcctccaatccatttttcacatggcttccttgttgatctttataaagtgaagcttttataaagttgaactcatagaagcagaaagtaaaatggtagctacctgggggaatatgttcaagagagctattgcacaacatggtggctacagttaataaatgtatatatagagagagtttagtctacaataaaaggaaagagaagaaaagtaatccaaggaagagaaaacaaagcaacaagttgtgataatagtagtagtaaaatttaacatataaagtccaaaaaaaaagctgaaattaaatcagattgtgatttcagatttggagtgtatagagtatattgttttatgaagttataatgttttgttttcttatttatcagaatgtctatgaacatactataatttgcatcccactagttataatcagctcatctttgatgtgagatatgtcattttttcttagaacattgtgccctcaagtcacatgtattatacttctggtcccaccacaaagcctttggaatacagagtgctattgaattggatttccatttggatttcttccaaagcctttgctttgagagcagcatatgaaataacaaaattggcatgggctggtttaactccatgcctaaccgttgttttctgttgatgatagtgtgtgggatagttgaaaatgcaatccacaatgttgcttttctatgcagacaaattacattatatataatttagcatttatcttcagttatattctgaagcttcacacatttcagtaaacatctctcttatagcttatgatagataattgataacaatagaggactgaaaataaagaagcagaaatgattgtactcatttactcgctagcacacaatagccaaccttggatttttctccttcatagttttctggcaaaggcggtaatgtgagataacagtttgttcaaaagcattcaaatagaaataagataaatgtgttcaagaaaagagagaagacaagcatggaggcaacatggtaaccatgtaggggggcactcagagtaggagaagtggtgtcaaaggaggcaagaccaaaatcaagtaaagtttagaggcatatacaaaaatttgtattgcgttttaagtgtgtatctaaagtactggagaaatttgagcaggggtggtatacaataatgatttacatttttttatatcaccctgcatggaagataagaccatagtgggagaaactcgatacatgtattagttaagtgtctattgaactattttggtttgtagaatagtgaaagagaaaatagcattcagaaatatgactagtatagattataaatcatatggttaattgtatttatatcattagtaattctgataactcatatttctggtatgatattttcctctaagtatcctaaatagcagtttggagtatacttagcaagagtattttttaaaaatacatgagcccaagatagataaaggcatatgtatttttatatctatgagtttttaaaaagttaatggaagaattggattgagtaggcaaaaacttgaaagtttaaccgtgcattgtactcagaacatctttttctaagtttaagcaagaatttagcatttactaaattttatgaggtttgctattctattctaagaaagctgttatgatattagagtaataaccctgaactaggtgctaagaacctgatttctaatcgaagagctgctattaaatgtttgatttgaaggacctagtgttcattcaggatatttttaactcaaatattctatgataatcattgtaactttaaacgatacagatagaactaaggagcataattaactgtattatccaatgttattgagaataattgttagccattactaaagtgtaatacatatattacatatatttatattttacatatatttatatataaacgtatactaatattttgtataaaatacagaagataatatgtataatataaagtatataaatatttttatataatattcatatataaaaatatataaacagatatattaatataaatttatgtacatatataaaagatatgggatcttgctatgttgcccaggctgctggcctctaacttctggactcaaacaattctcccatttcagcctcctgagtagatggggttatgggcacgtaaaatgttggtacaatgtgaacttttaaaaatctttttgaatttccacttttgggaagagggagtaaacatactttaccttatgccttccactaagtataactaatagctctggccagtatatagaaaacaagcataagaagactctaaaagtttagaaaaaaggcagaccaagtagggaacttgggacccaaggaaagaggatgctgagttctttgtggtttttttgttcgtttgtttcgtatatgccagcttaagaagctggcaatccacaaatggcaatgggtacaaacaacaaaaaaaaaggttctaacaaaactctgctctctgtagtcaaagggctagtaaagaagcagcttagcaagatagaaaacttttatataataatcaatataattggcaaaaattcaccaagccattttaactaataaagaacaaacacacacaaacttgtgcgtgtgtgtgtgtgtgtatatgtgcttatagacccatgtattcagagcctccaaaatctgcaatggatgaaatgtccatacaattaaataatcaaattgtagttaattttaaatctgcaacatggctgtatcatagaggaaatcaactgatcaaggcacatcattgttttaaatgttcctgctgctacttgtattatatttggtcattcttgcattgctataaagaaatacctgagactaggtaatttataaagaaaagaggttgaatcggctcacagttccccaggtggtacaggaagcatggttccagcaactgcttgacttctcgggaggcctcaggagcttttactcatggtggaatgcgaagcaggagcaggcacatgacatggcaaaaaaggggagcaagagatcaggggaggaggtgccacacattaaaaaaaaaaaaaaaacggatatcctgagaactcactcactgtcaggaggaaagcactaaaccatgaaggatcatcctccgtaatccaaatacttccaaccaggccccacttccaacactagaaattaaaattcaacatgagattaggcagcgacatatattcaaactatatcatcactattcccaattcaaattaaatgttagtaatagtttatctgattatggatcaggtactcattttcctcttgcaagacatttaaaaacagcaacagtagcctaaccatctcaaactttcagaaatatagatgtagtaaatttcaaataaagcataaacctagattacagctatttatagaaaaaactaaatattatagatcgttagaatagacatacaaaaacatactaaatattttaatgttgcagttttaaaggattctaactgacattttacaaatacatctatttataattgtcataccttaatgggacaatgaaattaaaaccccttatttacaaaaatcctcctcttcccaaaatgggcttcctaaatatgtggtctaattttgttgtgaaattagattatatgttatagtaccaacctttaatcttgtacaattaaatatacaattaaaatggaagtttttattcatttactaaaatcatgttatacaatagtttttagtttatgcaagcagttcttcatttcagaaggaaaaaataaaatggcagaagtctaaaattcaaataattattaaataattattgggtaagtaaatcttaaagttcaaaaggttttatatctctcattttctttgttgcccttcacagagctttgtggaggcatctttcactggtcttctggagttacatttaattccttctcctaaataatatatttctgtaggaatgtcttttctaggttgtgttattttggttgtttactgttgcttctgtttttattttctatgagagagagagagagagaagagaagtaaaagagggaatgattcaggtccaaatagaaaatattacccagtataaaaaattataaatctgttatttaagttcaaaagacctttttaacccctatcttcactaagttggggaaaatttttatccattttacagataaggccgtagaggcaaaaagagttaaagtgttttctaagaacactgcatggcacattataaagacttaaataataatagaatgaatgtttgaatgactaatactaataagtgataagtggggaatataatctaggcttctctctgttaatgattacactgccactaactacattgctgatcacattaaatataaaaaatctcatgaagctattaaattctactttgtttcaaggattgacatttcttagaaaatatttatttatttttttctctttctccaaaccatgtgctatttaatgactgagaaagaaaaaagtcataatcttttggactttgggaaatagtacataattcacttaaggtactgtatttagtctcttaaacatatgatacttaatccagacctttcctttaaatgtcatatttgccttcttctagaacttatatatttttcaaacaaatgagatgttttctattcctacaccttgctatatccacttacatgagcttctcagtttacaatcatcttagtcttataaaactttatttttgttggttaacatatacattttacacttaggaacaggtgtaaactctgacatctggaacatccatcagaaaagaatgtccctgaggcacctacacgagaggatatcaatacacattcaaacaatgacatttcagacagataaatgcccttatatcagggcaccaaataagaaaaataggaagcatgagcagagagcacatgacataaaatgaaatacatatgtagagattgaccatcatttgcaggggttagggcctgattccatggtgaaactaaagtccattttaaaatgggagatttaacatttaacagctaagcacataaaaaggaattcataacagaaaaacctacatcaattgaagtgacctttctcagagatatcttttacagattttccttctggctgtttcttttcttccttgtcctaccgtagacctttttcaatagggacctttttcttttcttccctcatgtatactcttattttaccctccttagtcttatgaatcagcttccactggagaagattttgagatgatatttctgtcctggtgtgtgaatactttggaacttccagaatccaccatactgtatgagactttttctctcaggaaattggctcatattattgtagtagggaaaacaaacaaacatgaaatcctgccacagttgatgcacatgaaattcctcaaaaaatttttttgtcatgttttctttattttatcccatccatgtagaagtctaagggatgccttttgctaactctaattcataagtccaaaatcagagcataagaagaaagttacaaatttgatatgggaataattatatgaatgataaaaggagtattattattataataaattagattaatatccactgaagaatgaattcaataaatatcataaaaatacaaaatcatcatccttttgttttcttaatcagaatctttgtttgcatggcaactaatatagttccacagaggaaaattttgagaatttataaaattgatctaaatatctaaatcttaaggttcattttactatcataagcttaaaggacacagcttttcaaaaaagataaaagaaaatattgttcttgggaaatgcaatgaccagggcttctggaatctcacccccacaccctaagttgcctcatttaaatatgcactcttactaagccaacatcacaatgtgtatgtaatctccacggaatatgtgaaaatgacaaggcatcactcatatgtaatggcattgaaaatatgtaagaatgaccagcatggacatatgccattacttaattgttacacacaaggcttaggagtaactgagcctaacaaatctgactcttaaggcttattatggtgaaaaaaaggaatttcttagagaagtgctttttaagtagattattgttacaagtcaaaatgatgcgactggtgcttcaatctcctgagagtttttgacaatggccagtgtggttacttctggcaatagaactctaggaaactcaatcagtgaccttggcactatgccatccaaaatgatattaagaggtaatgctcgtattgttcctctattagaaagttcagctggttccaaatatacgtcatggcacatcagggataattccaagaacaaaattaacttggattcaattcactgactactatatataaaataatggagacagtctgttctcaaatggaatattattattggaatatatgtacatgtatggtgaagagatcttagcttgagagactgtgttgaattcatcctaggattcagatacatttgagcaaatttaatgagtttgttcaagttggtctggttgcataaagtgctaattaacttactaggaaagaacaaatctcttggaaaaaagagctaagtgcacacaaacttgctttaagtttcaaaaaaatatgaaaatttttgactatggatcagatgttagctgtttcaccccttaaagacaggtagtagagaattgagtagagaataaagtagagctggttccctaaaatctctgtaaaacatgaaaaaatataagcaatcatagcctatgtagcagaatgtagtactttccataattttgataattattgacctctgtggtcacattactgaagtagcaaaccaatccagcctctgtgtacaatgaagaaaaaaaaataactatataagagctgaaacatcagagcattagaagaaagacatatcctcacaatcgctggagtaggagaaaagataaatggaggactacttgtgttatccaagaagagtatgcaagaggaaatcgtactctctgcttatcagttgaataaatgctttcagcgatccccatggggacagcttgaagtctgttggagaaatctgagagatgtcaaaacttctgaaatcttatggatagtggcaacaccagaaaaatactattttattactctggagtcattatatttactcctagactagtttattttggaaatttgggtaacaaatatctattgtttgggaatttcttcttcagattattctcataatgatttcatcttggaaatggctgaagtaaaaatcagtctgaataaggttttgatagaactctctattttgaacaaatgacctagataattttgcaccatcagctggctggaagtacaagtctgctttcaagattaattaaattttgtctctttaatcgatatataataaatgagtcaataatgattaagtcttgcctggacgtatgatcttacacaaacgaacaaagaagtgtgcctgcatccagtgccctgagtggcagaatcaggagggaggtgaagtaaaatgctgtctcagtcagaacatgaggcacctcatgcttatcatatgatgcagtaagacagggtgtgaaacctttgacttttcttcttgcacaagcagtgacgtcatgggcccgggtgtagatcaagatcaagattacacattagctgataccatatattttaccattcacttccattgtgaggtaaaaatgcttttatcagagttgggagaatgggaatcaaggaagcagtaaaagggaagagatggatgtcttatgccatttgcttctttgccttcttaggtgccacagttgggttttgtttctttctttctcttcatttttttagcctgtctgtttctaaatacacaaatgaagtggcaaacattggtaacttagggagaatcaataattgctaaaattcttctaactcaaaagaagtcacttaaaatatatatttaatatgctctctctctctctctctctctcacacacacacacacacacacacacatattttcacattaaatttacctaaagacaaaagcagaaatacatacagatacctttattccctattttggtatctttgtattttgtttttctatcctattcttcagaagaaaaaaactattatgcataaccttgtcaccagacctggaaccatattaaaagcttcccctttcaaccaagttttctcttattaggtaaataccatggactcatgcttatgtttaggaaaaaaatattgtgttatttgtgtaattaaaacgacccaacattttggtatctggtaatgcttctcttacatggcaatgtgtccggtgtctgtgacaggatgttctcagtagaaatgactgcaggggaaatgaaaacaaatcaaagtcttagaacttgagtttttggtttttctaaaataaatgttttcctcctcacagaaatgggaagtcaaatacctaatttatatgcttcatttaagcattaaataggaaaaaatggccaaacgtgattgaacattatgctagctgcaccaagatcagagaccaatactcagtacaggcccttttgcctcgttctgtttcatggtgaagaactaaccctccaatatgaccattagccatcttcagatgaatacttttaaacaagttgttaatgattgagtaaaagccatcccaattacaggaaaagtgcctcaccagtacagctacttcaattaataaattaaattatttcattttctaaatgaaaaacaccgtgttttaagcagagccctaagggaccatcagtattttttatatatctaattgctgtgttacggctatgctttcataatgttttgtaactttctaatccattgtccgtcaataaaattattttgcccttaacattgaaagcatgtttacttcaaacaccatccttcccctcccacgtaccaacaaaaagggggcgggattaaaaaacaaaacaaaacaaaaccttttgactatagaaaagaagaaagcatttataaacagcaaagcttaggagacaaaattaaaatgattttaatttgttaactcgacggaaagaataggtcaccttttaaatgtgtattctgagaactgagttttctcaggcatcttttaagtgagtaaagggagagataattgagattgggaaatataatatgctaagaagtgctcatgtaaggaatacactgcccctgagatctcaaaagtctttcaaagactgaaatatcatgggaaatacatgatagttgaattcagtcagttttattcccagtgtgaaataattgtgattaaatatagtcataatatctcttaataaagttttaacttttcctatagcatataagtttaaagttaatctgaaatgaattcttcaccttggaaaaagatgaattcgtttgtcataaaagataattttatttgccaacaacaatgcaaacattttacctcctacagaaagcaagaccatcaggaaatatgcttatttacttttcaattttgattaagttcatacaagtgcattgggggaaaattgatttttgtttccctttcgttaaactgatgatcttctgtatcttctacacaaagatcaaatgtgtgacttttcttacatgtaaaaaacatctgtggtagcactcccttaagtatgttttgcacaatgaaacaacaaaaaaatggttcttcatattactttcataatattctatatgtaccaacaattgatactgatagtaaaaatgagaaaaagcaatatgggaaaattctaaattaacaacttttaatggttagaaactatatttttagctcatcattgtaaattcatacattattttcatatttatatatgaatatatgtactttttataaacaaaaataatggaaaatgcaaaacctcttcagtctgtgtcaatcccagattactaccctaacaaaatgttacacagcaataaatccagagaaagaattctagcgaactatgtacatgtatccagcatacaaacagacttcctctttggcaggaataacaacatgggttggaagcagggctctgtggcccattacaaaagactgagtgaggaagttgttatatctccagaaggtagagtaagaggatgtgacagcagctaatcagacattccattccagagtttcaaacttagagagtatgagaaaaaagaggatccagttgagcttatttctggcagatacgtggagtagttagcacaacagttaatgtcagagatcgcagagggtcccaaattatggtgtatcttaagttgacaagtttcagggtcttggcttttctgcctaagcctggttttccaagacttcctttctataccatgatgtgcccttccaggaaatcccttttgtgtttagttagccaaagtgatttccatcatttacgcccaagaatcccactcataccatacctcacccatgatagcttaggcatgacatggataaatacatggcttaagtaaggtatgtgtttagaattagcattcactaaagaggaaatgtagttaactttacttgtataaacacacctgatatttagtttgaaacttcagattgttagtatttgattatttttgacactcactggcaatttcataatttttagactaataatgagaatatctcattgagctgaacaaaccattctatggcatgctttctttttagggatcatagaatggggtttttgttatttttatcctaattttttatctcccaggagctactgaatttctatgattacctataaagtatcagaatcttaactggggctccagatggatgctttcatgattataaaggaaataaactttgactatgatttatttagacagaagtgggaagtggttcattttgaaaagaattatgcatgcatatataattcacatacaaaacacatttttctgtgaggtcacagatttcaggatgtagtcttaactagcatatctctctttaaagaaactactggaaatatctgaaataaaaaatagaataagactcactttccaaccaattcagaacaaaatgcctagaaagtaattacttgtaatagtcaaggtcaataaagctaatatttattatgcctctcctatgacctaggcaacatgttatgttctttatatgcattatcttacttgatatttatggcaaacctatcagaaacatattaccattgtgtgcatttaacaaatgaaagattaaaccttagataggtcagaaaatctattaaacatcacagggtaaaaagtggcatggctagtacagtaacctagatctgtctgactctaaaccccataattacaaacccgtaattacccccaatttagctggatacctggatattactgctaattaccagataaagagcaactatatgaaacaccttaggtgcccaacagaatagatatactttgatcttcttttaatccttggacattgatggttcagtctatcagtaaagctattgttttatcctagggctctccattttcttccacactatgaattttttcctttttcgggagtcagacgttgcctatctcagtcttctggaaactgaccatgacaattcagctgtgctacattgccagccaacctgctaaatgtgggcaatactgcctgtgcatttatccctattgttaatgtgtaggtgtcacacgtgagagaaggagggaggggaaaggggaataaagagaggtattttatataatgtagatatgtatttccttttccaagtagagggtaatatgtcaattgctttgtagttcctaagcctctgctttcatccctccagtctacacagcccaacacaataccaaaacattccatttaggctttcataaccaaaccaatactggccaccttgaaacaaataaacctgttcgtgaccaggttacttttgttgccttctagcctaggttacgggtggcctctagagagtttaacaatgtgtagctcaggcaaggtcaagggaaaatatgataacttgagtagctttctctttacacagtcgttatgccaactgctaggagaattggcattctcagtatccatccatattcccaactttgaaattcacattcatatccacaagacagtagacatttgtcctgaaagtcttttttttttttttttttttttttttagatgatggagtctagctctgtcgccaggctggagtgcagtggcacaatcttggctcactgcagcctccgcctcctggattcaagcaattctcctgcctcagcctcctgagtaggtgggactacaggcatgtgccaccacacccggctaaatttttttgcattttttagtagagatggtgtttcatcatgttggccaggatggtcttgatctcctgatctcatgatccgcctgcctcagcctcccaaagtgctgggattacaggcgtgagccacagcgccaggcctgtcctgaaaatttttacatctgtctgttagattaatttctctcaaaaggattttaaccaacatattttatggatatagacagacaaaatttgttatctttattatataaagaaaatcattggtaactaaactatagtgagaatgcaattgcttccacgataacctatgttcttttggaaattccaaacctgtgtaagctctttgatggagcaggaaaaaataatggagaagcatagaggaagaatgatgcaatgtaccattaaattactatttcttcctatcattcacttgactatcacaatatgatacaagctctgaaaaaaatttaagagaggtttccaagatacagaataataatctactctgatgcaaattaagtaatatcattcattagctgctgaaagcatctccaaaaataaaaacattctcttgtaggatgattgttttggtattatcttaatttccttctttgagtatgagaagaattgagggtgaataataatgaaagcatactgtgcacgattcaagtggcgcttagaaccttattctacttcttgtgccatcagaaagtcaatttcacataatatttttttactcccacttgcaacataaaccttctacattttaagtcatgcttagcatgtttttcttctgtgtgtgtctgcatgcacatgtgtctgtctgtacctgaatatgtctgtttgtgtgtgtatttgtgtgtgtgagagagagaaaaagagaaagaatatgctaagaagatagaaaaaggaagcttgttttgcttttatatttcagcagtctttattctaaaagaattctcctagatttaggggagaaaagatatgccaggaaagaaatttatttcttcattcaacaaatattcactgaatgcctagaacatgtcaggtacttgggatgatatgtaaggtttttttaaaaaagttaaaaataaatctttgccctcgttaaacttacattcttgtgtgtgagacaatgaataataaacagtaaaagtatagtattctttaaatatatgtcatattgagaaaaaaagtaaggaaaatagaatctatagtgctgggagagggcgcaggtagtaaggataggcttagttaagaaggtaacattgagagaacacttaatagaggtgagtgggttagccttgtagatgttgtaggggaagagagcttgaggcagaaggaatgggtagaacaaattttctgaagtgaaagaaagcatggcacatgcgagaaaaaagaaaaaaaatacagcaagaaggtcaggatggtggattgaaagtaaactttcaggaattcaggtcaaagagatactaatatgagtgaagcaaattttgtaatctattataataaatttatattttcttttgaatggaggagaatcattggcagattctgagcaaaggtgttataggacctctcactaatatttttaaagtagcattctgcagtatttggaataatgatagaaggatggtctatctgggacacaattacagtaaatcaggtgaaagataatggaggcttggaccatggtgatagcagaggttgtgataaaaattgatgtggtcctagaaatattttgaagacagaaaaaaaatagatttccctgatggtataaaatatgaatgaaaaagaagttttggagagggatctaaggttatgaaagggtggtttccatcaactgagatcagaaagattgtaggatggaaacacttgtgagaagaaagttcaaaagttcattttttgtagacagcaagtttgaaatgtctattacacatccaagtggacatgttcagtgggcaactggacatgtgaatctggaggaggattatggctggattagatcacagagggagtgtgtgtagatagatgaaagatgagtatgaattactaagttttgggggcaatatcaagaggtaggaaagaagagaatgaaccaatgtccgataaggaaaatagaatctattctagtgtttttgaatagaaagataacatgagaaatgattttacatgtttttgtgagagggcagaaaaatgaaaaaagaggaaggtcctgtttcctaaagattagttactacagaaagatattaaggtctccacaatagcaaaatatcaaaagcttgtctaagcccacaatgttctctgtagttgcttcacaagtctctgttgtttgaaggatattgcctcttaaagagtccaaattcacaatagcaatggatctctgccagatccccagagctattaaaatagcctgcaataaccttcagtggcccagaatcatccaatgttaccactaactcggctacatttggaaccctggcacaaatgctggaaccacctgtacttttgcaggaatttatggtcgctcagtgagtgctgccagaagggaatggtgttaaatcactgacagccttcccatctttcacaagtgtccctattgatagaaggtaaccagaacccagctggcaagagagtattttaacgctagctttgtacaaaggacagtatagaagacagggatataagcaggctcaagtgccaatgaataatgtctagtaatttccaatatttattattcagtatccatatgctctcttactatatttaaacttctaaatagtgacaataatgcaaaataatatttctactgtcatgatgcaactatctcacatataaatgatgatattttcattctttcccctaaaaatagaagaaaaatcttatcactcactgtaaccatttttgtggatgttaatttgatgttaattgctcttctagttcagtcacagttttattcactatatttattatttaaaataattagaaaaaaggtaggtaaaaagaacagaatggtgtgtatgtgtgtgtgtgtgtgtaaaattacaaaataggcaacaaaacgtatgcatagctggttgcatcctagtttctgtaattgatcacagacagtattttccatttatgatttcctttctccactatccattctgtggttcttttagcctaagctagccagaattttccccagtaagatagcttaaaacctaaacctttgtttctcaatgtctaatttctaagtaatactaccctttattggtttacatacagtcttctaaatattaaaataaaggagatcacaaataatctcttggggtctatacaaagagctctctctctccctcataataacggatatctgtcatgacagagcagagcacccttttctttgcctgttggcaggagaaaccttaaacagccaagtggctatcacaactttcaattcccaaaatcacttttagtcctttattgaaatgatttctctattttaaatgaagacttttaaactagcagaacccaagagtttcaggacagaaagcaaaagataaaaaaaaaaaaacttaaaggaaatattaactttacgagagagaagacatttttacttctatctttcaattcttggacctatatacacgagctatggatgtctgttggttcaaagcatgccctgaattttgtatgacagtgcctaaattttcaagattttgactttcagctctcagcaagtaattctactgttttattgctctgtaaggacacctgactttggtagagtacattttaagaggagtaaatatcataggtatgagaagattgctgcatgactcttttcactaaatgagttccttagtcagaaacattatgtgaaacatcatggtagagaataaggtctttagtaagttcatggatgtcagtgctagcaaaactaaagcaaagaggaaaagaaaagatttaaatagaataaatatccattccagtgaggataaattgctgtcctcttcatgatgaaactgtccagtgaagccactttgctaccagatggacagataatcccctgtaattcagaggtcaggtttggaatttagctttagtttttgctagtggcaagttgggcacttcttagtggcaattgtcagagaagtctcattgaatacggataggtgttgctgagctcattcataatctcttttttatgcagccatggtcattctgtactgaatccattgggcaaatgcagaggtattggggaaagaaaggtcaactaacgtgtatagagagaatcattgtctctctcttaatgattttctctgtaacaggtgttcttttgcaaatgaaattatgagatgcaaatatctttgctttttttcaacaggcttatttttctagtctgtttgggctgctataacaaagatatcaaaaactaggcattttataaatagcataaatttatttctcacagttctggaagctgggaagtccaagatcaaggtgccaatggtatcacacttccttgtgggcagtgccttctagctgtttcctcacctggtggaagggactgtctgggtctccagagtttttcttatgagggcaccaatcccattcctgagagttccaacctcataacctaattgtctctcaaaggctccaccttctactaccattacattggaagttagaatttcaacacatcaattttgggggcatacaaacattcagatcatagtatttatccacgtgctttgtcctctatcactaaactttttgtatttttttaagttccatcatatccatccaaataagaaaaatgaaaaagaaggcagtttagaagaatatgcgttatttattccccaaatatttattgattacctatgcttagtactctactacatgcttggtgatataatgttgagcaaaacaacaaggtaatccaaaagtgaataatgctgagcaaaataaacactggtctaaaggagtttacagtttaggagggtatacactagttaaataattgcacaaacatatgatttaaattcttataagtcctatgaagaaaaagagcatggagttaaggaggcacacagaagatctggtacagaggatcagggatgatttcccctaaagtgatatttgagctgagatatagagctgtactctacagcaattaattaaacaaaaaatttggaggaaggaagaaatatctttctagagagagagaaagcatacatgtaagtcctgatgtattttaagcatctgagataaggccagtgtaactagagggcatggtctcaggggaagagagatttgagatgatgctgcagatgtgagatgtgggaaccagcttatggagtgccttgaaggttagaggaagaattggggtcttcaaacacagcaaaggaaagccatcaaagaagcaaaagaaatatgtcatcagatttaaagagatcactcgggattcaatatagagcaagtgttcaaaaggggtaatagagaaaaatggagaccatcagtggttgaaatatcaccattagtaaaataattttgccatattttaagctaaatgggctctggggtattggctttagaagcaaattgccacttaaattgaatatatagaagaatccattctttacatacctcacaactcaagtatatagacacctctgttactcaaatggtagtcattggtcaatatagctcttctcaacccattcattatctgcatggtggggaaatctgcacaaacacccgtggtaagggaatcaccacttctaaggcaatggcagtgaggaactctgtggtcctatgtggagacagggtagctgagaaaggcatggactttggaggaaaggaacttggtttagaaatcagatttctcccttattacccatgtgcctttccgtaaattgttcatctcttcaagcctcgaacttcctaacttgaaatatttggtttaccagctgggtgccgtggctcatgcctgtaatcccagcactttgggaggccgaggtgggcagatcacgaggtcaggagttcaagaccagcctggccaagatggtgaaaccctgtctctactaaaaatacaaaaattagctgggcatgttggcgggtgcctgtaatcccagctactcggtaggctgagacagagaattgcttgaacctgggaggcagaggttgcagtgagccaagattgtgccactgcactccagcctgggcgacagagtgagtctctgccaaaaaaaaaaaaaaaaaaagaaagagagagagagatagagagggagggaggaaggaaggaaaaggaaagaaagaaagaaagaaagaaagaaagaaagaaagaaagaaagaaagaaagaaagaaagaaagaaagaagaaggaaggaaggaaagaaagaaaaagaaagaaagaaagaaggaaagaaagaaagaaagaaagaaagaaagaaagaaaagaaaagaaaagaaaagaataggaaataaatatttggcttaccatgtatataataacatctagtgcaaacagttaccacaatgattaataggagatactggttacacaagacctagcatacggtgtagttcgtagaaggtagcccattcatgttcattccctttgttaactaatctaaatgttcactgatagtatcttcaggtcagttaatgttacttccatacaacaatatcattaatatttattgtattttttgcctaaaattgtgcaccattttaatgcaattccattaattaaattatattataaacaaaacatgggaatcaaattttatttttctacttaaagttaaaacatctaggatatgggaattttgcagtaaaaacaataaatactgatgaattcaaacattcataaaactcagaagcaattaatctagaaaaaattactttattactgttaaatttagaagtcttgaaattatatgatttttctctcttccaaatagccagcaattctctcattatcttttttgttagaaagaggaaaaaagaaaataataagttagaatttgatagaagtcagactctatggtagacttttttatacttgtctcaatatttttttctaagcatcccctgtgatatatattattgtggctattagactggagatgaaagatgttcagaagaagaactctcccgggagattagcatatgagaaaggatgagagcgattccataggcaaatggcttctttaatgtcatcaaatcctcaacagaactcaacagcaaacagaaacttagtatcataaatagtagatacaaacttattactaatttttacaaaaattacagatttattgcaaaattattactagtttttcttcactatttagttcttcttttatatatttatctcaggagaaattgttctcatgagaaactacttaaaaatatttaactctggtgtctgaatatctgctagccaagcagtagaagtaatgtatgtgatgcttttatgacaggcatgtttcccctggctgttgtttaaaaccacatacgacttagttattgtgtaatatactaataacatatttcttttttgtccatgtaggccaatttgggaaaatgtgacatttatccagatgtttagtcaaacacattctaattaagttgtacaggtttacaaagaaaacaaattaaggcagtttaaaggaaaaatgtcttggaatttagtttgaaagacagcttgccttaataattttgatgatattctgagacttgattaatatatttttctctgaaatttgcaagttttaatgaagacagtaacaagctgggcatggtggctcaggtctgtaatcccagcactttgggatgccaagacaagagaatggcttaaggctaggagtttgagaccagactgggcaacatagagagacccccatctctataaaaaaattgaaaaaataaaataaaatttaaaattagccgggtgagggacgagatggtgctcacctgtagtctcagcaacttgggaggctgaggtggaaggattgcttgagcccaggagttcaaggctgcagggagctgattgtgccactgtactccagcctgggtcacagagtgaaactttgcctctaaaaataaataaacagcaacagaaaggtaaaattttcaaaccttctccatatatgtttacaggaggtatcttctaaacttgaaaatgaaagctagttataaatgtcaattacataaagattaaatttagaaactgacaagtgtagggtatacaaagcagtgaggtgtctttataaattctgccttcaggagttgaaatgtgcaagagtcaaaagatggtgattcaggatgctccatgttcaatgaggtttctttgttcagaaaccagtggtcagagaaatgactgaggtttcagtagaaaacctttttttcgtctttaatgacaatattaatgagtttgtaagtcagaaaaatcttaaacacaggttttccacacttagctcaactacacataaacatacacacacacacacacacacacaagaatggctacataacagaatggccatataacctattaacatataaaacatatataacataaaatggccacataacaacatcagtaggttattttttaatcaggaacacttttccttgccaactttgctctgaagtaaaagaatgatttaggaaaatttactggaatgattcaggaaagctgtacattttatcatacacacaatcaaaaagtttaaaagtcattatactcttgctttgtaattatctgttaggaaattttcaaagaaatatcagaaggaaaacagtgtatttttaaaagtcatgtagtacaataattctttttagtggatgaaatacactatcccagcaaatcaatctctggttcttgtatggaagatgatctctttgtagatgacaccttaatgctgtccattttgatacacactacgagaaaatagttaccagtaactactctctcccctggcattcttttggtggcccagcagatagactgtgacatcactggtggaaatgttgacataacgtaaagatcacctctagcattgatctgaggtcagggaagattctgagagctacgagacattcttaaagtgctttatacatactaggacataaaatccatttacaaatttgctttcattgttcttttagtcattaatagaattaactggatttgcacttgtacgtagagttaaaaggaaacctcttagaccaactggcctttttaaagcacacacatacacacacatacaaatctgtattttcttataaggaaagatgcaaaatatattgttatatgtatttgctttctttaaaatagatatcatatacatttaaacagctattatccctatggaaacagcatattctaaatttcccaatgaatttctttagtggatgaggagacaaattttaaaagaaggagcagaacatataagatgtcatgcataggtagtgccctaaactcttacctctatagaagtacagaatgaaataaacagatgaggcaaatatagataaaagaaaattcaatgtaaattgtctttgggggaaaagggataaaaatattgcctctcatagtggaaaatatttgattaaaggattacatactgacatcaggtttcttttttcttcatctgtctactcctccttggctagactcttttcttattcagagtaacactaaccatattcttccaggttcaatcaagagtaaaacggaatacctttccctccaggctagatcctggattactttttaattactctgattgggtcatatatttatccatgaaccaattattatggcaggaaacggattaagagtgacataggtagtgctgctatgaaatgaactctggatatattagtaaaagaagtggggaatcaatggtaggcaactaaatatgcaataaatgttctcttcatcaagaacaactctggcagggcaaatacttatagaatggccttccattctaatcaaattatgagttcaaagggaaaaaagttcaagtatgtttaaagaatagataataggtcagaatagacagaaatcataaagagtttgacataaaactataagaaaataaagaccaaatttagaatgtgacaaaaatttgatgagccaatgagtttgtattttagttctgaaacctatgaggaatcaaagctgatgtttggggaaaaaactgttacctgcacctagcaaagtacctggtacctcatatgcccttaatgaacaatgcatcttaaagaaactaacttggtaataacttgcactgtgaattagagtggtgggataatatactcagttaggataccagtgaaataaatcagtaatgcaattcaaagaacctatcaacttcttatttattaagtgtttttaggtacatgctaattgattcaaactgtattgaagtgtttgaagttggttcaaaactgttggaataaaaagctgttaagaaagttcaaaatagatactttctttttatgtttggatactggctccaactgattcaaactgattgtaaataattcaaaccaattaagagctaagacaaaatgttttatattgaaactgagtaaccataagtatttggagtcccttgaagctattgttttcttgaatattctttgagttaaattggaggtcttttagaaaagagcatcaaaaaaccgattgaaaatttgaaacttggaggctacgtgcatgaaaaattggaacaagctgtgagaactttggatccttttcagtgatacttttactgcaaacactgctgccgtcgataaaaccattcctcaccctggagagcagtagccacttgacaacagtttttacttgtattggaaggcatgcagagaaaaattagtcttggcacttgtctgtgagagtctgttctgtctctttcagtttgaggtttgcaacctacccaattctttctccccaatatataacaagtgatacttgatactttttcttcactcatgcttgagccacccccctaaatttggatatctgacgatttaccaacttgttctttgaatgaagcccctcatggaaatgtctccatcccagcaccccagaggttgctgaatttcattatttctggcttttcctgtcttgtgtctaaccacagaggacaaagattttttgtttaaaccaacagaggctgagaacttcgtcaagaacatcctgtaagaacaattaggcagtttattttgtgttgatagtgtggttctcacattaaacataatagagtcacatgtcagaaacgatctcgtagatacatgttgcttattcttgctaagcctccatttccttatcacaaaatgaagtcagtagcattcctacttcctaaaattattgtgagaaaaatgtgataatgcagtcaatgtgctcagcctgatatcttgcacataataatctcaataaatattagatccaagaagaacgggacctcagaagaaacactttatacatttgactgattacgtgtggggtgaaggggagtggtgggagactcttagaagatgtgggatttacaataaatttttaattagtgcaaggaatagagtagtttgcagcttatattttatggtgccatattagaaaagagatggcagaaggtagaaaaatcaagtgtgaccctgaggaatgctaacagatttgatggcttaggaaaattctgaaaaataatgtgccatttagcacattagtaaatatatatctagagtagaagcctataatacaggcaaagcaatccacggaaggccactaaagaatattggagattcaaaataaacagtttgataatgggaggattgtcattcaatgaatagtgtaccaatgatggttgtgaaaacttcctaaaagtaaaagttgaaagctaaagaaaacaaaatctgtttaggaaaggcctgaggaagaagacattaatatattcccatgcaaatctctaagtgtcgttttaaaaactaggtttatattgtagcaggtatggaaaactcagacaatagaattgaactaatgtgaactaatgttttctcatgaatcaaaatgtaaaatattaaaaaaaaattttataactataagtgaaagttcattcttttatggattttataatcatctcttctcagctaaaggaaattatcacctattttaaagcttttaattaaattaacatatgtaattgaattagattttacacatattggtctaccatacttactcctatttgctcagtgctagccaggtaaaaagatttaagaggagtctgtgaggtgccatctaacctcaagggcagaccctcaagtaaatcttatccatctcactgctccaactcttctcttccagagaggactagcacataggctatcctaggataaaagtagatatcacacaaaattcttatacctttaattttctttcagttgttttaaaatctataagcttagcctaaaattaccagcaaatacctttctgtgtgtatatagtctaccagttactttattaacgtttaatcagaactttagagacctcagagatgtgaacagaaggtggaaagaaaaataatttcatagtattgcaaacaataataattattactaattaaacttctattcttttcaaggtccatgacatatttatcttatgtcaacctcatccaactgtatgatgtagatacagattttactattttaaacctgccgaaagatagatgttagtaaaacaaggaactaacttttgaacccagatgttctgtttttcattttttaacagttttcttgaggaatgttttacatatcaaaaaaatcaagtgaatgattcaatggtttttgaattttactcaagtaaaaatttaacagccatcaccataaatcagttttagaacattctctttcctctaaaaagattactcatgttcatgtacatttagttctcattttcaaccacagtctcagacgaccactatcaactttctctcttgacagatttgccttttcgggacatttcatatgaatgcactcttatgctatgtggcctcctgtgtctgacttctttcatttaatgtaatgttttaggtcctcccatgatgtaacatgcattgataattcattactttttattgctgaatagcattctgttgtatgagcatagcacattttgttcattcattcattagttgatgggtatttcacttttccctcactttttgctattaaaaataatgctgctatgaacattcacacacacatctttgaacagacatatttttaatttctcttgggtatatacataggagtagaattattgaaacatatggtagttttatgtttaactttttgagaaaatgatgaactgttttccaaaatggctgtattattttacattgtcaccagcgttgcatgagggtccctattttctaaatcctccaaaataattttttcttgtctgctttattggttatagccattctagtgggtatgaaatgatatttcattgtggttttattttgcattttcctaatgacatgatttgagcatctttctgagtgcttctcaaccattcatgtaatttcttgggtgatacatttggcatatttttccccatttcttaattgggttgtattcttgagttctatgaggtctttgtaaattcttgatacaagttcttaacttaatatttgttttgcaaatattttctcccagtatgtggcttgtcttattaggttttaatggtgttttttgaagtacaaaagtttagaaatttattatgtcaaatttagcattttttttcttttgtggaccatgttctttgctggtatataagaaatttttgcctcattcgggtcataaagattttctatatttccttctacaatttgtatttttaagatattatatttaagtctattattcacttgagttaatttttagatatggtctgagatgagggtggaaatttacctcttcacatgtggatacatgagctaggcatttctgtttccaataacaaccctgttctaccataccaaacaggctagataaatatgagtggagatcatgtctgactggcttcctatagtgatttaatagcggttggatgaaactgcatacctagggacaagaagctgcaactcacctgagccaagaattgttgattgcgattagttcaattatttaacatcagagttccccacatcagttcttgctctgtgatggatttttcaactttaccatgatacaaaagtagaaaccatacttggaattttgaattttgatcttctccaggctagcattatacagtacaatattctttcttgtgatgctgggtagtgaccatgagttatagctcccagtcagtgacacaatcactagggcagactaccaatactctacagtgtcctgagttgccagcagttttcggatattgtgttttgtgtttttgcatctgatctcgtctacaaaatgtcagtttgtttctcctccttctggtgggaagaagaagaagaggaaggcaattactcttgagacaaacttgagataatttcccagcatgaagctggcaaaccaataatggccatcacacatgagttaggacttttgcaatctacgatcttgttcatcatttttttttttttgagacggagtcttgctctgtcaccaggctggagtgcagtggcccgatttcagctcactgcagcctccacctcccaggttcaagcgattcccttgcctcagcctcccgtgtagctgggactacaggcacacgccaccatgacaagaagtggatcaatgatgcgatgaaatcatcagcatcagttaaatccactgccaacacaaagaaaaaagctgggccagctaatgataagaaaaaaattacttgtcacatggatggaaaaccagataacagaagtatataggatatggcttggctgtgtccccacccaaatctcatcttgaattgtagctctcacaatttccacatgttgtgggaaggatccagtgggaggtaattgaatcatgggggtgcatctttcccaagctattctcataatagtgaataagtctcatgagatctaaaggggagttcccccgcacaagttctcttcttttgtctgctaccatgtgagatgtgcctttcactttctgccatgattgtgaagcctccccagccatgtgaaactgtgagtccattaaacctctttcttttgtaaatttcccagtgttgggtatgtctttatcagcagcatgaaaatgaactaatacagtatactctaagccttctgacaatccagagtaagacagtgtctttcaatataataaaagagtgtgccaatggtcctacttataagcaaatgtttatagcaagtcatagtggttccattgcttcaagtagcttataattttcctaatatgaaggtcagcaatgaggcagtaagtgcagatactgaaggtcttgacctttttaaggaagagcagcatagaataattgtggatgagaaatactttccagaacaaatattttacatcaataaaacaagcttattttggaagtgtatgccagtggatacacacattcctcaagagtccaagacagtgagaggattcaagacattgagagattgtttgaccttgctttgggatggaaatgggaaataccatagggttcaaattcaagccttttctaatctaccactcagagaaccctagagcattcaagaatgtgagcaagcatacattggatgacaacagctttgtttgaaaactggtttttgaactgttttattctgcaggcaagatattattgtaggaaaaacaacatcccatttatgattcttctgatcttaaacaatgctccagggtatccacagcataacagaaacatacattctgatgtaaaggttatatatttgcagctgaacatcatcacactcattcaaccaatggaccaaggtgcaatagcagcattcaaagcatacatttgcacaggctgttgaaacaactgaatgtgattgaatgatcctagatttctggaaaggtttacacattctaaatgttatccaggacatcgctgcagcataggaagaattcacacagcaatgcatagatggcatttggaagaaagttttgaatgcatatatgaacatatgcaaaagctttaatatagattctgctgttgatgaaatagtaagtaacaagatattagtgcttgggaaccagctagaattggatattgatgaagaggatattcgtgagtttgtttgcactgaggctgaagagctctgcagtgaggagctaattgaactagaggaagaaagaagaaattgaagcacaagaagaagttacacctgaggcaccaagaaagctcacaacaaggaaactagcagaggcatttgctactatcatcagtggcttatgggtgttagacaaaatggatgccaagtatgagggactcataattgacaggcagttacaggtgctaatgcttgctatagagaaatatataatgaaaataagaaaactgtagtcaaaatttggtatcgtcctgaagaacactatgcctgctaatccgtcaagtattgatggcttctgtcagctattctcaagcctcattcaaagagaaattaatgaccctgtcactgtcgcatcccgtcattcggcaattaatttttattcaatgcttcaaacaatcttcaggagcagcgtgctttcagctgtgtacctaagtggtgagtacccatacaaccattctgcttttcactttcactacagtatttaataaactaaaagaaagattcaatgatttattataaaatatactttgtattaggtgacgttacccaactgtagactagtgtaaatgttctgagaatgtttaagataggcaagcctaagcagtgatgttcaatagcctaggtgtattaaatgcattcttttcaacttaagatgagtttactggatataaccccatcataagttgaggagcatctgtactattcagcaacagaaaagagacaattactgattcacataacaatgtgaatgaatcccaaaacattatccagagtaaaataaccaaacacaggagtaaatgctgtacgattccattgatatgaaactgtaacaaaattagtccctggcagtagaaatcaaagcatcagtttcctggaaaagaagattggttggaaatgagtggtgagtgatttttttagataataaaatattctatatcttgatatgagtgtggctttcagaggtatatatttattaaaacccattgggctggggctgggggcagtgactcatgcctgtaatcccagcactttgggaggctgaggtgggcggatcacttggggttacttggccaacattgtgaaacctggtctctactaaaaatacaaaaaagttagtcaggtgtggtcgcatgtacctgtaattccagctacttgggaggctgaggcacaagaatcgcttgaaccttgcaggcaggggttgcagtgagccgagattgtgccactacactccagcctggggaacagagcaagaatctgtcagaaaaaaaaaaaaaacccgttggaatatgaattataattataaattataaactgtaaattatacctcattaaaacactacattaaaaatattttaagatctgtcctactgtattagttttctattgctgctataacaaattaacacaaacttactaacttaaaacaacacaaatttattattttattgtgtttaggccagaagctggaattttatcttattgggctacaattaaggactgccttcctttcaggaggctctaggggagaatccatttttagctactagaggccaatcacattccttggcttaattcaacttcaaacccagaaatgaccagtcaagtctgtattgcatcacatcatttggacactcttctgcctctctcttctacatttagggtctcttgtgattacattgggctcacctaaaataagggtagtccttattttaaagtcagtggattagcaatcttaattccatttgcaaccttaatttccttttgctttgcaatataacacattcacaggttccagagatctggacaccattttgctggggaggatgtacgaaggagtgctattctgaccacccctagaaacctagccatcacacctaatattgtttctatgagaaaataacaattattgaataatctgagccattcaatctatagccatctgttgaatggttactattacaagacactaaaagagtaatccataaataacacactttctgtgtctcattgacaatattatacaaggtattttcagatatattgtaagcattgtaaattgctaaatgaggtttgatacagtggcatgaaccaatagttttctgtatcctctgttatatagtagacacttctatattgaggaaaaatgctttttactgtagaaaatactggagattcagatatttatttcaagcacatacctgaacattaaaattacttattgctgtgaatgactaggaaacaaaaaaagcagcagccctgcctagcaggtatcatattgagcctcagggtgaagaacacttttgaaatcttctgaccattgccatctcactcatgctatcaattaacaaaacagaggtggggaggttaacttagcagttagagctaattcttccaagatacatgtttctgtttctgtaagattttctttaagacatagtcttcagatttgttccacctcatagtgttgaagtctaactttccttaaacaatattacaattatccttagaaatgtgtcagtagacttgatttaacagagaaaaacaaagtggatcattagttttgtgttagttaataactaactttatacctttaagccttgagcacagtcccttgatttattataaataacccagaaacctttcataattttcctaggctatgcattcctggatcccaccccaaaacattctaatttaatttatctgggttccagctagtatatcagggtttaaaaggtacccggtgatatttatctagtattgagaactactgttttaaggtcagagttaagaactacagaaataaagcaagaacatgaatgatttggctaaaaaaaagcaatctgagtttaccaccccaagagctgtattacaaacttaagcactgtccacagcctgaacaactggtatttttgtatagtaaattatatagccacatagccaatgtatgtctgatagtaaatacctgatagtaatccccatatatttaagtacataattattgaatcaatcaacctgtcaagtatcatcacacagtattttgttcttcagtcatctcaggatgattgaaaagatattaagaattttaaaacacattgattttttcacatattttgattcatttaatgtttcagttaaaaaaaatctgaattttttttttttttttttttttttttttttgagatggagtctcactctgtcaccaggctggagtgcagtggcgtgacctcagctcactgcaacctccacctcccggattcaagtgattctcctgcctcagcatcctgagtaagctgagactacaggcacacaccaccactgccagagctaatttttttttttcacttttggtagagatggggtttcaccgcgttggccaggatggtctcaatctcttgacctcgtgacccacctgccttggcctcccaaaatgctgggattacagaatagtctgaattttttaaaaaaatccatggctcaaacagcgtgttaatgtttgttcccatttttaagtgtccaagatatcaaagtgaggtaggaaatcagcaggacttattttctgagcgataatcatgaccctgccgatcaaagcagaatgcagtaaagaaacaagcggaaactagcagatggcgacaaaagcaacctccagttgccttcactgattaaagaccaccagcgctatttttaaacataactgtttaaaaatgccatgacaacgatccagaagttatcttatatggtttcaggaatttccccacccctttcctataaaattctgaaaaccagccccttaattagcatacaattaagagtaaggataaatatagctggccagcaatctacccggactgcccctctggactgctctgtttgggtacactgctggggctgctgctgctctggtctgttctgcctatggagcagccactttgctgtacaccgctactccgggccactctgcctataaggaagcactgctctgtgggacagtgatacggctgcacaccgctactcccgggaactctgtctttgggtcagccctgctctgtctacggagcagctattttgctgtatgctgttgttctaataaacttctttctttcactgctggctggcgcttgaattctttcctgagtgaagccaagaatcctcccaggctgaacgccaattcgggataaacctgcatccgctggataacttgataatgaatttttaaattaattttttcacttattgatccactgtaagtccaagatttctataatgttataacagatgcggtaataaatagaaaactatttagtgctaaaaaatcggtcgtattcctggatagaaatctttacaggaaattatttgtttgattgttttgtttgtttgggatgggatgtctacctctaaattttatttgaatcttaatatcaaaaagtgcatgtgtcccctaagggaaaaatattctcaaacaatagtgagtaagaaaacagtttgattagaagtcttagtcctccttttatccataaggttgatttgcctttattcgttggatacatgtaatatgggccattccctaatctcccttagataattatgggtactttcctaagtaactgtgcacctgaaaaggagagctaattataattttcatgcactggctccaataaaacactgttcttgagtatgcagaccaaaacttttaacaatattaaaggcttaagggtggtaaacagaattcaaagtaaattaatctcacaatcagttctgtgtggtccaagccccactctgaggatagcttcatatttcctttattcatggtttgaatcactatcacagcgtattgcagaattccatactggcttcctggtacatagagtaaaggctattacagtaccaagtaaaagcaaaagccactgagcctcccttttcctaacacagcaataagtgaaatattgtaatatatgcataagggtattgaagtgattattattatcattaaatatgatatgtattaaaatatttctttttttttcttctcttgtacacaggagataatggtgagggttaggtatgtggctcgcctatattttgtacaatctcacaagagaaccatgacagaactagaggaaaatagatgccactcagagatatcagacacaaagaacagtgatatcatttttatgtttagcttttggacatgactttgggttagctcccattgagagggaaaagcccacttaagatcgcatcatagaaaagagttatgttcaggggggccattttagaaatcatgtattttttaaaagaaagtatggtatgggaatttaggtagctattgtttctcacatgaatacatttctttctttgcttttcaacaggcttgcaccccttggacctctaaagtgagttacattcagtaacagattctttgtccttgaaatttcagtattatcagtgatgaccagggtaaaagattgagatttaagtaagatttgagttatctaatagtaagaaaccaagtagaaaagccacatgttactattgaggagataacaggagagtctatgtccttgtctttaaaaaaatgcttttcttgaatttggtgaggtaccccaatgtccttctaataaaaatctcctctcatttctctcttattttttacttctcttttcttctcagtttctcagtcattttctgtttcctgcaaccgaagacccctaagttacacagaaatcagatttaaaaatacagactcagacgaatgtaaatattttgaattgaatggagtgaaaagtgctgagactcctacccatgttcagagatatgaaagtggtggtcaatgagaaagaatctttaaacaaccacaagcagtgaccggttggaacctgggcctcctgaagatgaagttcagagagcaggtggctgttgtcatagaactgcttaaatagaatgaggaatggtaggcccaccgagtagaatggctacatctgacaggcctagtaatgaaattggagactggaaagcccaggccttatgggtttcaaagcacaggatgaaattcagaatccttgtgtgagtgtacagaacagtcccttattacttgtagctatgctgcggagcacacagaaaactaattccacggatgcattttgcaccttgctgaattataatattagttgaattcacaaactctcatgtatgtgaaagctaaggcattaattaagaaagagtggactcggtataaagtcataataacactctggcatccaatttccagaatttaaaattatctctctgcctaaatagctgtggggttctaaataagttactcaaattatatgtcttacttttcatggggaatactaacaatattgttagtagcattatttcatgaatagctatattttaaagaataaattagataacccacaccaaacacttaacacagtgcctagtacaaagatagtacttggatgttagctagtaattcaagtaaaatctttaataattttcaaatagatgaaaaagaatttgtattaagtgtatttatcaaacgattacttactctgctacacaatcttcatgttcaaagaaatttaatgcatatttcttacaatcagaaatcttccaattattctgggaaggtctgaataaaacttgcaaaaatttaaatgataacataggagaaatagaaggtcgaagtagtgagacaagaactcagtcataaggttttataagattaagtgctcaatgaatgctcttggaaaaaggtgttatatttttcttaaatatcttttttatcaaatgactatttgatctactgtatttgaagagttaaactcatttctacatgtcttatttttcttatgttcttatagcaaggatcagtcagatctaaatacttgtttcagaactgcacactttgggttttgacatttatttttttatttcctaagccagaaagtgaatctttgaaaactgtaagacaataatccaagtggaaaatgctttgaaagctctttgtagttggcaataaggctttattaatgacaattgttctcacatgatggatgtacttgccataatacctatgggcttatactgtgactgttagtatttccttgaacaattccctaagtgaccatatataatttaatacacctagcctcccaaaacacattgtcttgtggatttgtcagtagtgtatcttaatgagaaaaaatgtcctccttaaatcaaatgtaaattacttttttaaaaaaatctaactacagataaaacgtacttttaaaaatataatcttgcaatacatttattaaaattttgttaaatgaatcatattttccattgatttgcactattatattagagatgtgttcctatggtaagaaatttgaccaaaagtgaatatataatacaacttagaaatgcagagtattttagattacatattcaacaagaaaacattttgctgaaataatatgtaaaaacatatctgtaaagttttctgcattcctgtatatgaattagaaaaataataccttaatcacatagctattgtcgggagcaattaaataagactttaaatgctataaatttcacaatactgtgcaatatttttatcataatcccctttacaaacaatatggcttatctgtagtttgccttgcttgctatacaaatgctcaggtgaccatctggtacaaaatggtgctcagaatcatttacatctctctttttcttctaagttatttcattatctgtttagcaataatttcacataaagataataacatctattttgcttaattttctattgatatctagtttccaacaatattttagctttctatttacttttaaaatgtggtttgcaacatagcaagtgagttcctctttcagtaaagatcgaggacagagaatttgggtcatctcgcctaaagtgtgtaatagctaaaaaaataccaatctggtttcaaagtggaaaaagtgacataaagatgttgagccgaccccttctcactttatttctatggatcatgtcatcattctaattcaagtgtaacagcagaagttggattctcttcatgctacaatcatataagagatgttgctaaaatgtacacttgtcatattcctttaaatacacccagaaaggatttattctttccattctgtcttctccattccactaccataacttgagttcagggggacttttctctccctggaccatatatcccaataatctaatataactacatataacaccaatcatttcacacactagatgctgatctaatcttctgctcacctcactaatcttatattcttgaaaacaactctaatcgtattactgcaaaaatatcaatagctcattacttaagcagtaaaatttcaaactcttaaatctacaagtgaaggtctactgtcattgacccctgcttttcatccagaccccaattcttcctgacactcccatgaaactggagtacttgctcttacttatcagtaccattctagcactcttacctccatttgttcgcttgtgctagttctgggtatactgccgccgtcttcccacactgatgatcgcacccaaatagaaggtcattcattgattttttactatcaaaacatttaattattcacaagacaatggcctccacttcatccatgctgctgcaaattacaggatttcacattccattctatgtatcccctaaatctgtcaaaacaaaaacaaataatttaatgctcatttgcttgatttatttctgtcttaaattatttggggtactagtaaaagaatgagattagattcagacaatctctaagcctcctaaagttcaaagattatattccaggcactcagaatatcatgacaaaatgtgaatatttttgttgattaaagtgttatgttaaagcttgtgtttgactaaaagtgaaccgctggatgaattttcacaatgtgaacacacccaagtaaccaacacccaaagagacagaatgtcagtggcaccccacaaaacacctctagtaaccccttccagttcaccagatccatcagtaggcaactgctatcttgacttgtaaaagcacaaattaattggaatattttggaacatcatggacatggaatttctctcacagtttgtactgttttgtgtctggcttgttgttgtcgttgttgtttaacattatggttgtgagattcatcaaacaaacaaaggttgtgtttgaaagacattttgcaaatatttgtttttaagttactgtcaatacttgaaaaggtcgctagatgtagatgttcttagccttccaaggtatcatgatttctcagtttcctgctctacctagcacagacagcacctaattcttattaaacacaatcagcaaaccgtagaagtgtaataatactgttaaaaaatctcgttcccagccaggcgcggtggttcatgcctgtaatcccagcactttgggaggctgaggcaggtggatcacctgatgtcaggagttcgagaccaacctggccaacatgacaaaaccccgtctctactaaaagtacaaaatagccgggcgtggtggtgggcgcctgtaatcccagttactcaggaggctgaggcaggagaatcgcttgaacccgggaggtggaggttgcagtgagccgagatcgtgccactgcactccagcctgggcaaaaagagtgagactgcatctcaaaaaaaaaaacaacaaaaaaaaacaaaaaacaaaaaacaaaaaaaccccagctagttcccatttaataactctctaaaaagtctagatcccttaaattaaattatcctgtttaggcacagtggtaaatatttagcaaactacaaaatatttagaaaacattatagaaaatgttgcttcagaagctaaacttttttaggtttaatataatgacttcagacatcccaaaagatgtagtcagaacttataaactgataagcacagttgttttgaactgaagatttttcttatttataacttctcaattacagttcaaaaactaagggaaagtggctgtttatattcaattttctgaacagtttaaatttggattaaactctgatactttaaagatcaatttttttaaaactttgacaaaacttgatggatcccaaaagagaggagatttgaatcattaaaataggttccacgggcaagaaaaacgaactgaaatcaatataacatttccaaatgaatttccatcattttcacagctgttcagaagacagaagatagatctttaccctttattcatttattcattcagccaacaaatattattgaacatatactgtgtgtgccaagcgctgtttggaacaatgtgccccagcagtgaacaagtaggcaaaaatccctgcctcatggagcgcacattctagcaaaagaagaaagatacaattaataaataaattatacactaacttaaaaggcaatatgtactacaggaaagagaaaaaaagatatctgggtgataatggtgacatgatttaaaataagataaccagggaaggcctaacggatgctgtggttcttgagcagagcaggctcactcttcttatttgccaggcacccctggaaacgatagggtagccaagaaaggagctgccagtttcaggtaggtgtttctccttggcttggaaaactctgctctgcagggggtgagactcagcaagatgggaagtagaactggcactgctaaaagaacagacacagggcagaggtccattcatttcccacatttagaagtagtgctggggaacggacatgaagaagatgagggagatagataggggcacatctcaggaaaaacatcccgaggtgagggcactacagaggctctgagaccaaaagtgcctggcaaatttgaagaagctagagttgaggcagagtcatctggtggcaaatggtgggagatgcggtcagcatgtaataagggacagaacagcgggattctgcaaaggcttttaaggactggcttctcatctaagtgaagtagggtgggagttgttgctacaggattttgagcaaaggaatgacgtgatcaattttgtgttttaaagaatcatgataaatatcaaagtactacagtaaagcttagtaaacatcttcaagtaaatattttaatttacttgcattctcattcagggtgtcatctctttacatcaattgttacctgcataaatagttctgtggtcctggagaaaagaagaggcttttgttttacttgcaggtagatgcatggttttggaaaaggccctgcatctctctgcagttttttccccttatctgtaaaattaacctattaggccaaatggtcaaatattatatcttactttgtgaaaaaggtactgaaaatgtgcaccacgaagtttcttgaattattctcattttcaaaacttagtttaaacattttccatctaattttaggctttaagcaactttgaaaatcaatgatttcattctggcaaaagtttaggagttcgttctgatattaataaaattgttgtgctactcaaaatagagctttttggttgcctattgcagatgggaatattctcctgtgttttctctgtgtactataaataaagtttattattaaactcagaaacatttattgggagaaaactgcatacttcatttaaaataagaatggtatacagcatatattacttttctattaaaaatggattaatcgaaagtatctgaatgctgataatttcaatattcctgagatattgttgtttataagcatcttaaagcagaatgtaactttgtgatcatatagcaactaataaaagaaaatttacatagactttagcatttgatcaatcctagaaattattcctggaaacatccaagtgactttcttaactggagtaaatttttaaaataagattaatgtaatagtttagcatacttatgagtcacatcattggcacagtcagtgcagtctggatataaatgcaacctagatgttaagagcattttctacatcttggaataaactttttgggagaatgtatttttttcttttctcatccgagtgcccactccaagtcctcacagtcagctctgtttgaccaccacttttaagcacataactgctcagtaactcacacatgaatagcaacttcagaagagagccctattcattgaacaagttggtgaataaaatttggggaaaattaagtctctcaagtgctgatcaacatttcccttggcatcctattagtctcacgctgtaactgcctgacaataagactgtgcaattatcttacaattacagcttcaagattttaacctgaatgggtttgttgggtcccactttcattatttttgccatatgttatactaatgaatgttttgttgtattctttcttagccaagtctttctcctgagactaggaagtcaacacagtaatatctaatctactgcataatgagaaagatatattaatcatttgatagtttcttttcttgctttctttttttcctttttcatgactgactggctattagacctttcctgttgaagtgaattaaatgggaatttttagaaaataaaatagaagaaaaggggaagaaaatcttaagaggaggaagaaaagtaagtagagaaagagggaaaaagaaagaagaaatatgagagacaaaaattacaatacaagaaaaactgtggttaaaaagaaaacaactctctgatttgcttcccacttcatttgtcaggctaactagggcctaaaacctttaaattttaccacaagaaacatattaccactcatttttagagtaaaaatggacaaaattagaaagttatatttttattcatttattcctgtctcaaatcatattctttactagaattccaaaattttgaattagagctcacacctcgaaccataaaattagtgaatatattcaggtttcttagttttgtgtttaacagtgtacttacttcatcctgaaaatcttgagtatctgtttctataccaaatttcattcatttattcactcactcatatttacgtattcaggcacttaacctatcagaaatgttgcttattttacactgtattcatgtaggaaatcagggatttgtttgatttaacatcaaattatgaaaatttgtttctggtcaaatatttacagcatgggggaaagtttattctgagagcttcttcagaataaaagatagaataaatgataaataccattctgtttctagacagaaacagaaataagaaaaaaaagtcaccctacaaagaagcttctttgatagtctgatttcctcaaaccaactaaatcatatgtttaatatttaaaatgtcccagaaatagttcttacacctatcaaaacatacttcagcataaaaaatgtaaatagatcagtggaaacagagcctagtatatgtaaaaactcaatatgcaataaggcaaacataacaatttaatgagaaaagaattgactattttagacgtgctattggaaaaactcaccatgtactgagaaaacaaaagtcagcttagattttcatctctgtctttacaaaaagaaagtctagttgaagaatgagtttggattgggggaggaaataacaaagataaacattatagcttgtggaaaactagatgtgaatgtatcaggatgaaaaatagtatttccaaaaacaaggaaaaaataagaaaaaaaaacatttactatctaaaactttaagatatcagcatgcaaattaaaatgtaaaatgacaaatatattcacaatatacatggctgaatgtttaataaccttactatataatgaaattttataaataactcagaagagtatgtgtacctcagtaaggaaaaaaggaggtaaagaaaaacaaggcaccaaaatcaaatgaaaaatgcattattaaataaattcttgtgtattttaattatattaaaagatttatatttgagaatgatcaaaacaatataaaagtaaaacattccatttttttctaacttcatgggctatggtgaaataatgctacatctctacaatggaaatgcttccataaatatcatagcttacacaagtaattccatgcaaaggggaaaatttgagtgaaaaaacagaatcaaactacatagagtattttttttctaattcttcatagacaggtaagtagatagatggtaaataaataagggctggaatgaaatacatttgaccctggagcaataaggatttgaactatgtgggtccactcatatgcagatttttttcaacagaaccaaaatcaaaaatacagtattagcaggatgtgaaacttgcatatactgaggcccaacttttctatacacaggttccactgggcaaattggggtacttgagtatgtatggatttatgtatatatggaggtcctggaaccaatccccagtgagggaagaccttacatagcaatgtaaacagtgatgatgtgttgatgatgacattatggctggtttctatctttgaaatttaaatttatttatttattttatttatttatttttaagacagagtttcgctcttgttgcccaggctggagggcaatggcgcgatcttggctcaccataacctccgcctcctgggttcaagcaattttcccacctcagcctcccgagtagctgggattacaggcatgcgccaccatgaccggctaattttgtatttttactagagatggggtttctccatgttggtcaggctggtctcgaactcccgacgttaggtgattcgactgccttggcttacaggcgtgagccactccacccggcctaaaatttaaatttcttaatttatctttttacttattaatttacagttttctatacttaaaacaaggatgttacagttataataaagaaccggtaaatatttttaataaaaatgcatcatcctccagctgtccttttctgccttcacatgccagaaggactttacaaaatcaaccaacatgaaatgtgaagatttggaaatgagtgcatttgaccctgagatagcctgcttcttttctcagaccacactcaggccacactttccttctacttcaccatcaatactcaccttcacaatttgtgggcatgtctggcttctgaactagaccccaagatccttcaagagcgtgaaactctctgcttctacccttatccagctatccccacctccctctatcataattctcagtcattacagcagccagaaggcctcttaaaatttgtatcagattattttactctgctcaaaagcctctgatggtgtcttttcaatgagagtaaaatcatcttcttacaatagcttaccacgctgtctggcccaccattattcactctccactttcacaacttcctctactctctcctttgttctctttactgcaagtgttctagtatctttcttgatcttcaacctttcctaggatggttgcaccacagggccttagaagaggctattctctctgcctgaaactcttactgaaatcaccccgtttacaatcacacacctgtagtcctcacaatcccttttactctggtttacttttgtcactagcacttatcacctaataaactttaaagtttagttatatattgtgtttttgtttgactttcctaccagtatgtaaattcagtgaggcttgggatttttatttcttctctctgttattatctcctgtgcctaaaatagtgcttggcttgtagtatttgttgacaaaataaaagtttatagtactggcccctaaaataggaggaaacacacatataaatatatatttagtaaatgttttttaccaaaaatttaaaaatcactttatataaattatttatctttatcaacttcaagttgtttcttgcttctcctacctccaaaatatttattaaaagggggttgagggaaatgggacagataaacttctacattcaacagtgtaataccaaattttatttttaataatgttgtttcctcagttgaagtacaaaatttaggggataaaaagtaagatctatttttttaccattacattagaaattttttttggtagaacacaatcagagatctcttatctcatcaaaacttgttacatgtttttgtcttttgctttaatttatagaatggatatatacaatgccgatattttctcaataatttgtttccagggaaatgtttctctcctgcccaagatattggtgttaaattagaaaagttggatgataaatgagagtagcagagttgaaagctggttgtttaattaggaatagataatctcatgcaatgagaaaagactaatccagtaagatttgtaaatttctctgtaaatcagagtaaataactcacatacgatattaactcatttacttacaatgctcagaatgaatgttaatatggtatgtgagttatttactctaggtcctacaatagggacagaatacagaagtgcacccaggaattatctaatatgtagcctcgtgagcactgttgtgccccccagcctagtgctgtgaggggcagtgagttgcatttagagacacttgggactcctaggcaccggtggagtcctcctcacacagtagcagcattggccgtcaactttcaggaagtctccataaagtactgcaggttggctgaatgagtggagcaacttcaaagggagtctcagtgatcctctttctcaatcttaaagctggtcagttccatcagtttttatggctgcatagtattccatggtgcatatgtgccacattttcttaatccagtctatcattgttggacatttgggttggttccaagtctttgctattgtgaatgagttcatgtcctttgtagggacgtggatgaaattggaaatcatcattctcagtaaactattgcaaggacaaaaaaccaaacaccgcatgttctcactcataggtgggaattgaacagtgagaacacatggactcaggaaggggaacatcacactctggggactgttgtggggtggggggaggggggagggatagcattaggagatatacttaatgctaaatgaggcgttaatgggtgcagcacaccagcatgacacatgtatacatatgtaactaacctgcacattgtacacatgtaccctaaaacttaaagtataataataataaaataaaataaaataaaataaaataaaataaaataaaaaaactttataataaacatttcagcataagtttcaaaaaaaaaaagaaaaaaagctggtcagttcctaaaggttggcttagttcatcagccctgtttttaatctattttgaaaaagtttcaaattaatttaaagcttaatgtggcatatagtataaatatgctacccattcaaaatcctaaaagccaactaaccaagataagggtcttgtctagtttccagaagtttaacaggacaaattctccaagatttggcaaatgatgagtacaattatatgccccaatttacatcataggcataggttcacattcctatctactctcttcctccagaatgaggctttaacatgattgccacacaaacttatataatactgggaagattgaactacaaagagattgacctttatttacacctgagagggttctcctgacacttttagcttattcttgttcttagaaggggagggtccaatttcaacatagctacaacttacatcttattctagcaaaaatttactgaaaaaagtatgtatgttttctggtcataaaatagactattttgtgaaaatagtctgcatgctgaattgtgctttcaccactaaatgacagacaaaatcaacagattattcatcttatgctttggtataattatttaatcaacttaaaattgcacaaagctatcctagcctacaaacagtggacaattaaaaaaaaaaagcattgtaagaataagatatttaaaatgcattcatggagcaatccctaagtttagcttgaaggagtttattttacctcagtaaatttctacctagttatcaattgtcctcagaaatgccatattagctcactattaaatctaaaaaagaaatcttcaaaatcagcagtgaatttttctttcttaacataaaacatttgaaatgacctgtttctctgtttttgccacaggcaaaaaatgtgacctattagtctcttaaaaaaaaaaaaaagccacaacccccaacaaaacagaaagctgaacatctggagaaaatctagtaccctaagattaattatacaatgtagtagcaggtggtgctaagaactattaagctgatttaataaaaagggcaaatatctccaattccatttcttccaataaattcctacaagcaggtgcaacagcacagccgacttagttttctcctgttaagtaaaaaagagctttcgttatttttttatttttagaatctctgggccattactgtaataaaatatcactgtacactatgttttatttttgtcattgaaaggaaatataaataatgcataatcaaagtatctaaatttctgaaacaactgttgatatgctgacagattatgtggatgaaaataaaccagtctaaatataaagctacttttcttttcattaaaaggggttaatgttttgaagctaaatccaaataataaaaatatcttaagaaaacagccttttaaaatgaaagaaaatccttgttctcagagcatgtatacattttatttcattaatgtcacttaaacttctcaggtctcaattttctcatttctgaagtaaaaatagacaatttgatcactccatattttaataatggcctaattctaagctttttgggtaattttcctttttaaaaaatgaatgtccatcttttccatcttccattccaagatggccaaataatacaagattaagacaggatatggaatctgaattcagctagattgacacctcagtaagtggagttaagttttaattgctggcaatcattgaaaacactaagggtaatagagtcagaaatactgcatgattacttaaatgttgtgactactgtcatggttagtactgagtgtcaacttgattggattgaaggatgcaaagtattgatcctgggcacgtcagtgagggtgttgccaaaggagattaacatttgagaaagtgggctaggaaaggcagatccacccttaatctgggtgggcaccatctaatcagctgccagcacagctagaatataaagtaggcagaaaaaggtgaaaagactagactggcctagcctcccagcctatatctttctcctgtgctggatgcttcctggcctaaaatactggactcaaagtttttctgtttggggagtcagactggctctccttgctcctcagcttgcagatggcccattgtgggaccttgcgaccatgtgagttaatacttactaaactcccctttatatatatcatatatatataattatatatatgtataatgagttgtgtctctagagaaccctgactaatacagattttggtaccaggagtggttctagaggaacagaatattaaggatgaaggtctttcattggtaccagggtttctggagttggctgcttaatatgattagacttcaaaaatgctaaggaatctacttataaaaggatggagcaactaatagtccttgatgtgaagtgtttagagagttatgcaaaataaatgcatgagatactcctgatacactgctcaagagaggtgaggagtttagtgactctacgcatactaccttttaccatatgtggtgaaccaaggacataatgaagctggttaagttcagtggacaaagagatgaaataaaataatgaactcagggattctaactcctgctacagaagcagatattgagcctcaaatctgctaagattgccctgagtgggagtcttatccgtggaaaaacagacacaagctcttatcatgtgagtggctgacctgcaatgaaagaggcatgcacaacctcgccaggtgtctactgttaaaatgaggatattgattggaaaagaatggcactttgcaatttggaatggggacatgagggagcactctgataaagctgggggtcactgagtttctaaactctgatgaaccttttttgtcagaagaaacaatttccccacctctccagtagaggtaacatcccctccctgacccatgctgccatcagcctttccacctttgtctgaggagataaaccctgcactgcctgagacaacagtgacggtatcccctgaggtagttgccagacacgataatgttgattctcctaaggagccaccgccaacacccttgtttgcttctagacctataactagactaacgtcctggtgggcccctagaggtgaggttgagactgtgacccatgaggaagtgtgctacactctaaaagaactgcttgagttttccaatttatataagcagaaatctgaagaacaggcatggcaattgatattaaggatgtgtaataatggttgaaggaacatagaggtggatcaggctgaatttattgattgggcccactaactaggggctctgcatttaatgttgcatcttggggagttaaaaatggttctaagagtttatttgcttggttagctgaaatatggattaaaagatggccctggctgggcatggtggctcacacctgtaatcccagcactttgggaggccaaggtgggtggatcacaaggtcaggagtttgagaccagcctggacaacattgtgaaaccctgtctctactaaaaatacaaaaaaaacagctgggtgtggtcgtgggcacctgtaattccagctacttgggaggttgaggtaggagaattgcttaaactctggagatagaggttgcagcgagccaagatgtgccattgcactccagcctggctgacaagagtgaaactttgccttaaaaaaaaaaaaaaaggtggcccactgtgagtgagctggaaatgcctgatctcccttggtttaatgtagaggaagggatccaaaggcttgggtgattgggatggtggagtgggttagtcacttgagacctactcataacagctagggggggtccaaaagatatacccgtgaccaatgccttgtgaaatagatttgtgaaggcagcacctgcatctttgaagagccctgtaattgctcttctctgtatgtcagatctaacagtggaaaccacagtcactcaactacaaaatttaaatataatgggaataattggatcctaaggtgacaggggccaagtcgtggcactcaaccatcaaaggcaaggttagcatagctaccgtaatagacagcagaggcaaagcagcaatcagaatggtctgatttgcagagagctctggcattggctaattaataagagtgttcctataagtgaaattgatgggaagcttatgcaagcagaaaactgctagatcgaatggacaaaaggctaatttgaattataaaaacagagaatcacagcccctcaatcaattttcagacttgagtcagttacagacccagaaccccttgaatgaaggggaggccgggtccccttgaggaaagagacctctacattaccaacaatttatgcagtgactctcccatccttccataaggagacctccaaccttttaccagggtaactgtgcattgtggaacaggaaatgaccagatatttcagggactactggacactggttctgagctgacgttgattccaggggacccaaaacgtcattgtgctcctctagttacagtaggggcttatggaggtcagataattaacggatttttagctcaagtctgacttacagtgggtccagttggtccctggattcatcctgtcatcattttcccagtgtcagaatgcataattggcatagacatacttagcagatggcagtacccccaaattggctctctgactggtagggtgagggctactatggtgggaaaggccaaatggaagccattagagctgcctatatctagaacaatagtaaatcaaaaacaatatcacatccctggaggggttgtggatattagtgtcatcatcaaggacttaaaatatgcaagggtgatgatttccaccacatccccattcaactctcccatttggcctgtgcagaaaacagatggatcttggagaatgatggtggattatcctaagcttaaccaagtggtgactcaaattgtagctgctgaaccagatgtggtttcattgcttgagcaatttaacacatctccacacacatatatatatatgtgtgtgtgtgtgtgtatatatatatatatatatatgttatattagagttctctagagagacagaatagagagacagatatatatatacacacacacatatatatgtgtgtttattaagtcacaccgttctctagagagacagaactatacacatatatgtgtacatatacatatacaatatataatctgtctctctattagttctgtctctcgagagaacgctgactaatataactacctatattgctttaaaattttagcacttataaactgacatgtataaaatgacatttttcattaagtttttaatcgatgccagtcatagaatacttgcgggcaatgccaatagaagtctgtgataactaatctattttgcagacctcacacattaatgtggaaaactttagtgaatcatgaagtctgaattttaattttttaatctatatcttaatatacttttttttaaattatactttaagttttagggtacatgtgcacaacgtgcaggtctgttacatatgtatacatgtgccatgttggtgtgctgcacccattaactcgtcatttaacattaggtatatctcctaatgctatccatcccccctccccccaccccacaacaggtcccactgtgtgatgttccccttcctgtgtccatgtgatctcattgttcaattcccacctatgagtgagaacatgcggtgtctggttttttgtccttgtgatagtttgctgagaatgatggtttccagcttcatccatgtccctacaaaggacacgaactcatcattctttatggctgcatagtattccatggtgtatatgtgccacattttcttaatccagtctatcattattggacatttggcttggttccaagtctttgctattgtgaatagtgccacaataaacatacgtgtgcatgtgtctttatagcagcatgatttagaatcctttgggtatatacccagtaatgggatggctgggtcagatggtatttctaggtctagatccctgaggaatcgccacactgacttccacaacagttgaactagtttacagtcccacaaacagtgtaaaagtgtttctatttctccacatcctctccagcaactgttgtttcctgactttttaatgatcaccattccaactggtgtgagatggtatctgattgtggttttgatttgcatttctctgatggccagtgatgatgagcattttttcacgtgtcttttggctgcataaatgtcttcttttgagaagtgtctgttcatatcctttgcccacttgttgatggggttgtttgtttttccttgtaaatttgtttgagtttattgtagattctggatattagccctttgccagatgagtagattgtaaaaattttctcccattctgtaggttgccttttcactctgatggtagtttcttttgctttgcagaagttctttagtttaatttgatctcatttgtcaattttggcttctgttgccattgcttttgatgttttagacatgaagtccttgcccatgcctatgtcctgaatggtaatgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgttaaagatcagatagctgtagatatgcggcattatttctgaaggccgtgttctgttccattaatctatatctctgttttggtaccagtaccatgctgctttggttactgtagccttgtagtatagtttgaagtcaggtagtgtgatgcctccagctttgttcttttggcttaggattgacttggcaatgtggcctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttattttgttgagcagtggtttgtaattctccttgaagaggtccttcacatcccttgtaagttggattcctaagtattttattctctttgaagcaattgtgaatgggagttcactcatgatttggctctctgtttgtctgttattggtgtataagaatgcttgtgatttttgcacattgattttgtatcctgagactttgctgaagttgtttatcaccttaaggagattttgggctgagatgatggggttttctagatttacaatcatgtcatctgcaaacagggacaatttgacttcctcttttcctaattgaataccctttatttcctcctcctgcctgattgccctggtcaaaacttccaacactatgttgaataggagtggtgagagagggcatccctgtcttgtagcagttttcaaagggaatgcttccagtttttgccattcagtatgatattggctgtgggtttgtcatagatagttcttattattttgagatacgtcccatcaattcctaatttattgagagtttttagcatgaaggttgttgaattttgtcaaaggccttttctgcatctattgagataatcatgtggtttttgtcattggtcctgtttatatgctggattacatttatcattttgcatatattgaaccagccttgcatcccagggatgaggcccacttgatcatggtggataagctttttgatgtgctgctggattcagtttgccagtattttattgaggatttatgcattgatgttcgtcagggatattggtctaaaattctcttttttttttttgttgtgtctctgccaggctttggtatcaggataatgctgatctcataaaatgcattagggaggacttcctctttttctattgattggaatagtttcagaaggaatggtatcagctcctccttgtacctctggtagaatttggctgtgaatccatcttgtcctggattttttttggttggtaagctgttaattattgcctcaatttcagagcctgttattggtctattcagagattcaacttcttcctggtttagtcttgggagggtgtatgtgttgaggaatttatccatttcttctagattttctagtttatttgtgtagaggtgattgtagtattctctgatggtagtttgtatttctgtggggtcagtggtgatatcccctttatcattttttattgcgtctatttgattcttctctcttttcttctttattagtcttgctggcggtctatcaattttgttgatcttttcaaaaaaccagctcctggaatcattgattttttgaagggttttttgtgtctctatttccttcagttctgctctgattttagttatttcttgccttctgctagcttttgaatgtgtttgctcttgcttctctagttcttttaattgtgatgttagagtgtcaattttagatctttccaggtttctcttgtgggcatttggtgctataaatttccctcacacactgctttgaatgtgtcccagagattctggtatgttgtgtctttgttctcgttggtttcaaagaacatctttatttctgtcttcatttcgttatgtacccagtagtcattcaggagcaggttgttcagtttccatgtagttgactggttttgagtgagtttcttaatcctgagttctagtttgattaccctgtggtctgagagacagtttgttataatttctgttcttttacatttgctgaggagagctttattcccactatgtggtcaattttggaataggtgtggtgtggtgctaaaaaaaatgtatattctgttgatttggggtggagagttgtgtagatgtctattaggtccgcttggtgcagagctgagttcaattcctgggtatccttgttaacttcctctctcattgatctgtataatgttgacagtgggttgttaaagtctcccattattattgtgtgggagtttaagtctctttgtaggtcactaaggacttgctttatgaatctgggtgctcctgtattgggtgcatatatatttaggatagttagctcttcttgttgaattgatccctttaccattatgtaatggccttctttgtttctttcgatctttgttggtttaaagtctgttttatcagagactaggatcgcaactcctgcctttttttgttttccatttgcttggtagatcttcctccaaccctttattttgagcctatgtgtgtttctgcatgtgagatgggtttcctgaatacagcacactgatggatcttgactctttatccaatttgccagtttgtcttttaattggagcatttagcccatttacatttaaggttaatattgttatgtgtgaatttgatcctgacgttatgatgttagctggttattttgcttgttagttgatgcagtttcttcctagccttgatggtctttacaatttggcatgtttttgcagtggctggtactggttgttcctttccatgttgagtgcttccttcaggagctcttttagggcaggcctggtggtgacaatatgtctcagcatttgcttgtctgtaaagtatttcatttctccttcacttatgaagcttagtttggctggataggaaattctgggctgaaaattcttttctttaagaatgttgaatattggcctccactctcttctggcttgtagagcttctgcggagtgatcagctgttagtctgatgggcttccctttgtgagtaacctgacctttctctctgactgcccttaacattttttctttcatttcaactttggtgaatctgacaattatgtgtcttggagttgctcttctcaaggagtatctttttggtgttctctgtatttcctgaatttgaatgttggcctgccttactagattgggaaagctctcctggataatatcctgcagagtgttttccaacttggtttcattctccccgtcactttcaggtacaccagtcagatgtagatttggtcttttcacatagtcccatatttcttggaggctttgttcatttctttttattcttttttctctaaacttctcttctcacttcatttcattcatttgatcttccatcactgatacactttcttccagttgattgaatcggctactgaggcttgtgcattcgtcacatagttctcgtgccgtggttttcagctccatcaggtcctttaaagacttctctgcattggttattctagttagccatttgtctaattttttttcaaggtttttaacctctttgctatgggttcgaacttcctcctttagctcggagtagtttgatcgtctgaagccttcttctctcaactagtcatagtcattctccatccagctttgttccattactggtgaggagctgcgttcctttggaggaggagaggtgctctgatttttagagtttccagtttttctgctctgttttttccccatctttgtggttttatctacctttggtctttgatgatggtgacgtacagatggggttttggtgtggctgtcctgtttgttagttttccttctaacagtcaggatcctcaactgcaggtctgttggagtttgctggaggtccactccagacgctgtttgcctgggtatcagcagcagaggctgcagaacagcggatattggtgaacagcaaatgttgctgcctgatcgttgctctggaagttttgtctcagagtactcagccgtgtgaggtgtcagtctgcccctactggggggtgcctcccagttaggctactcgggggtcagggacccatttgaagaggcagtctgtctgttctcagatctccagctgcatgctgggagaaccactactctcttcaaagctgtcagacagggacatttaagtctgcagaggtttctgctgccttttgtttggctatgccctgcccccagaggtggtctacagaggcaggcaggcctccttgagctgtggtgggctccacccagttcgagcttcccagccactttgtttacctactcaagcccagcaatgcaggcgcccctccctcagcctcgctgctaccttgcagtttgatctcagactgctgtgctagcaatgagcaaggctccgtgggtgtaggaccctccaaggcaggcaggggatattatctcctggtgtgccatttgctaagaccgttggaaaagcacagtattagggtgggagtgacctgattttccaggtgccatctgtcacccctttctttgactaggaaagggagttccctgaccccttgcacttcctgggtgaggcaatgccttgccctgcttcagctcacactcggtgcaccacacccactgtccaacactccccagtgagatgaacctggtacctcagttggaaatgcagaaatcactcgtcttctgcgtcgctcacactgggagctgtagacaggagctgttcctattcggccattttggctccaccaaatatactttttctaaaatgtatttctcaactatttctgtataagcttgaggcacaaaatatattatataaaataattttatttcacatctgaaacaaaacacttctcaacttacttttaaattattgtgttttctttttcattaatttactacattttttaaacttttaagtttaggggtacatgtgcaggttttttacataggttaacttgtgccattggggtttgttgtacagattatttcatcacccaggtattaagcctattacccattagttatttttccagatcctctctctccttccatcctccaccctctgtagcccctagtgtgtgctgttcctctctatgtttccatgtgttctcatcaatgattgtgtgatttatttcctccaagagtccattaggccaagtagtgtaaattatacaacacataggtgtcgaatatttgatttgtattcattatatgatagtaaaaatatgcttagttatatttactttctaacctttatacatggttcccaatatgtatcacaatttgggcttcagcgatactgcttgccacattgctaaattctctgcatacttattgctgaaagacgacatacctgcctcaccacatagcaatttctatcaatacatttccctattaaaccatcaaaataattttatacatatatttgtaaatatagcatttgaaaacattgtagctctctggttgtaagatatttttgaaagacaggtccactgtattttgaggattggttcatctgtttgtgttttcaaatccccagataattacctcaaaagtaaaaccataatgaacctgatctttattccattcttctaatatagccttctacctcacagcctgagaaactcagtgaaaagaagaaagttattattcattgaagatgattaaagcagtccctgtgaattctttctttaaaagtgaacaagacagcaaatatttggtgtgtttgaaagaatactactgaaatccaagataagaagaggcactgaaaatattttgagatgcagcccccagcctttagaatgagtgtttccttttcatcacagataagttatgttatattctatagcaatataacaaaatattatcatattacttatccattttgtatagccacaaagaatgatgagctttttttactgataatgtcaagccaaaataactattcaatgaggaaaaaaaggaagataatcgatacttcagcctatctactatcttttttctagccatcacaattactcctctacatattttttctttccttctctccctaattctggctttctctttccatcacctgtaaatcaaacatgaaaaatttaaaaaacatatattatctcaacctttaaggagcttagaacctcaaagagtaaatataaatgattaaaataaactgcattgaggtttgggcaaaagattatgatagggtaaaagataggatagaagcaaagtatcataggagtagagagaggaagttaccaccaactgagatctgaagggtgagtctgagtccgatgaagagggaggggctcctgggtgaggagagtgtgggcattccagataacaaaagaaattaagtgaggcttaaagatagagataaaactgtggtagtgtctgccagctgtgtgctacaattcattttgtctccttcctggacattcatcaacactatttcccagcttctctctcaattttgtatttaggtgtggcttgtgacaatttcccaccaataaaatgtgagcagaaatgatgtatattacttctgagccaagcccaccctccctttcacatttgtcagttaaataccaaaatgtaccttcaggatggcagagtcacaagacgggaagaagctctgttcctgagacactgtcagaagaaggcctcgcccctctatgcactattgtctaaacaagaagtacacatccattgtgtttaagccattacacatttgtcctatctcagctaacataggggctaaatggtggtagtcatgggggagacttgcaggctagattaaagcatttgatctttattataagggcaataaggagccactgaagggcttttaattggaaagtgtcatgttcaaaacaccggttatcttcaattagctttaatgaagatgaatatatagccattgttttaaataattcaggtaattttccccagactcctgcccttctcacatgataaataatatatgcatgatttactcgatttactcaaatagttttagtaaatcattgtatgcaaaatgatagcccatcttttatttatttatttatttttattttttgatgaagtctcgctgtgttgcccaggctggagttcattgcgcaatcttggctcactgcaacatcctcctccctcgttctagcaattcctctgcctcagcctcccgagtagctgggattacaggtgcacaccaccatgcctggctaatttttttctgtgtttttaatagagatggtgtttcaccgtgttggtcagactggtctcgaactcctgacctcaggcaatcctacccgcctcagccacccaaagtgctggaattaccagcgtgagccactgtgcccagacccatagcccatcttgatacagataataatcataaatatctggagttgaaaggatttaatagataattttctcatagtccattattttacagaaaaaaagaaccataaaggtgagatgctcaaagtcacgagtggttgttaagagcaaagtgtgagattaggaactacaaccaaattcttttgctatcattccaaggctttttacactttgtttagctgttttaatttctttagcccaagtacttgaaacctatcagattactctggggacatgaattaaatgattagccactaaaaagttaaagttttgcactaaaaataaataaactatcaagccattaaaagatgtggagaatcttttttccatttatgtaaaaaatatcattggtattttgataaagaatgcattaaatctgtggatctctttgggtgggtatggcaactttagcaatattaattcatccgatctatgaatgcaggatgtctttccatttatttgtgtcctcttcaattttttcatcaatgttttataattttcagtgtagagatctttcacgtccttgcttaaggtaaggcatcttacttttttgtagctatgtaaatgggatttttaaaaatttctttttcagatggttcactattagcatgtagaaccacaaaggagctagaatagccaaagcatcctgaacagaaagaacaaagtaggaggcatcacactacgtctttcaaaatatactataaatctatagtaaccaaaatagcatggtactagcataaaggcagacacataaaccaaaggagtagaatgaggccccagatatggattcatacacctacagccacctaattttttacaaacatgccaagaacacacactgatgcaaagatagtcgctttaaaaaatgatactgggaaaattggatacccacatgcagaagagtgagactagacccctacctgtcaccatatacaaaaaacaactaaaaatgaattagacttaaatgtaaaacccaagaatgtgaaattaatagaacaaaacataggagaaatactttatggctttgggcagggataacagacttttgaatgttcttaccacaaaaaaattataaattcatgcggtgacagatacactaaatactctgatttaatcattacacaacatatacacattctgaaacatcaaattgtactccataaatatgtacaattataatgtgtcaattttaagaaataataagaacacccaaggacataaaaaagcaatttataaaagaagaagtatgcttactttataatttattacctctgaaagaatcaaacatctattcaaagctaaatgaaaaccccccaaaaaagacatggaggaaacttaaatgcatattagtaagtgaagaaaaccaatctgaaaaggctatggactgtgtgattacaattatatgacattctggaaaagggaaaactatggagaccctaaaaataatcagcttttgctgaggaaagaggtaaagagggatgactaggtgaagcatagaggattttagggcagtgtaactactctctatgatactataatggtaaataaatatcattatacctccatccaatgccaagagtgaatgataatgatatgtcaatataggatcatcagttataacaaatgtactactctggtgggagatactgattatggggaggctatgtataagtaggggcaggcagcatatggaaaaatctctgtattttcttctcaattttgctgtgaatctaaaactgctctaaaaaataaagtctattttctaaaaagttataattttggcaatagcattatatttatgaatttggaaatatctatggaattttaagaatatagaaatacaataaattatttcttctgcctttgattaattgagacttcgttgaactaaaatgaatgaaatatttttacaccttacatctccctacaaacaacgtctctatatcagttaaagaaagtattgtgatgacaattttctatctttgtctttaaaatgttatgtgttcataatctgactcttctgtacatcttcctatactcatttcctagtcttgaagggaattgccacagcccctaagtgttactctgctgccgtttgtagaatacctgatgtgactgaattgacttagatcggcattttgcctgtgctgccaaataataagagataaaaggcactctgttgaggaagttggtttttaattttcctggagtaactaaaagcccatggctgttactggtaagaatgatagaaatatatccatctgcaaatataagtataagagagatgaatatatcaaataaaaatgaaggaacattagagtagcttacagatcagtaaataagagactataataaagcacatgatggcacatattaagaaagtattagccagtgtggacattttcctgcaattgatattaatttggtgccaatacagatccaaagaaggaaaaacaatcttagtctctaatggcaaactggaaactaatggaaataatatgtgtaatgtgtgttaaaacttctgaatagcacagttgcatttagctctttatcttctaatctcataaacacaaaggtataatccataattaattgtaaataaatgaatcagtctaaatctatatatttaaaatatatagtataaatattttaaaattacatgtactatatatttaaatatatagcatacaaatatttttatttatataaatatataaatatataaataaataaatatatttatttacatataataaacatatatttattatatataaataaaatattatatataaaatggaatatccacctttaatggtgccttaggttatatactatacatatatatatatagtatatagtatatacgtctacctaaaataatgactatatgtgtgtgtacaaaatatgtaattagaaaatatacatctctttgagtagtgatatttcagttaatctacatgttaatggaatatccgcctttactggtgctttaggttatatattatatatataatgatttatatatcatatctataacctaaaggatataacatatatatatatatatatatatatattatataacctaaagcaccagtaaaggtggatactccattaacatgtagaaatcatttcaaagtaaacttgaaataacaagtgattctagtctttcaacattgtatggctcatgatggtaggttcaagaataggttatacccatctgcacattgaacatgcttttacaaatgaacattgaatacattaggaatggcaaacatattgataatatgtatgacagccaaatctgagagaacaggaagttgacctaggataagagatgtaggaattgcagaaagagaaacattcagtgtaattctaactttgggtgagaaagctgtcgattcctcattttccttacgtgtaaaatggtcatgatcataactatcttataagttttatgtgagaattagaaattgtacacacccacatacaacacgtgatgtctggcatcgtatctggtacatggcaggcatcttaaacacggtagcctaattatcattattattaatattatttttggattacaattattgtcactttaagcaccacagatcaaagttctcattcagttcgtcaatacactgtttctttcagaatgaatggtaaatgacatgaatatttaactgaaagattactacttgaagagatgtacatgttctaattatatattatgtgcacatatatagtcattactttaggtagaagaatatacatattttattctactaggattaaaataaatgatattatgctacagaagtatggttactaattacttgattatttcataagaaaaaaataatttgccacagctgttatctgaagtttgaaaactttttgcgaaagctgtatgaaagtgttcttcattttacaagaatgaataaaaggtagttaacttaaaaaaaaatgcttcaagcatattatttcatgatggccctggagagtattggacagaaagttcaggataaactataaaaggcagtgtgaagagacggggctggtgaaaggggccaaggggctatggggccatgtgaatccatgtggaaaaatgatcggtgctggagaaggttaaattctcagtccctgaagtctcgctgttgtggctacagcccaagaaagttaatgaaagaaaggagcactgacaactcctgctgcttcgacaggagcttaccacctcattactggccagattcttacaaccaaaagaaaagaatacttctgccaagaaaaagagtaagagctagagtgagagagtcatccaagcaaagcattgctgatattgggtgaggatcaaagtaatatcaaacaaagagaactggacaagaaatagctgagccaagagctatgaccagactagacaagtatccaaaccctaggcaggagacatggaaaggacagttaaatctcttagtcctccctgcagcacaggaaaaagtaaatgaagtgacaccatctgctcactttcccaaaagagagagtttcaactcctcatggttagcaaggcaaacactttcagaaacattattctaattgcaaatgattagaaatgattcctagaagtgaagacttaactcacagtgtgcctgattaatgaacattttctgcacatcccactgcaccttgagtttactttgagagcactggctagagacagtttctgaggctttgaaaacatcctcttaaagataataggatgttacactttttctctctgtttctcgaagcatacaaatacatgatttttttttccctaaagcaccataggaaatcacagtgttctttcaagactagcaaatgcagtttttgtttcaggtttggggaagggggttttggggtgtgtgtgtgtgtgtgtgtgtgtgtgtgtgtgtgtaccaaactggagatgtgaggggcgtacagatccactaaaattaaatgttaaaacataaatgtaaatatatatatagtaataccttccatggagatatatttcttgctgtagatttagatatttaactcctagtgtcatctctttcaggagtagatcatcactataccaaagttaaaactgacaataccaagcattggtggagaagtggagcaaacagaactctcatacattgctggtggatgtaaattcagaaagctgtttggtagtatctagcaaatcggaacctaaactctctctctgtcccagcaattacataattcagtataagcataaacaaaacacatatgtatatgtacctcaaaagacatgaactagaatttttttagaattattaatcaaactggagacaatgccaacagaagactggataaatgaactgcggtatattctcaaaatagaatactgcacagcatgggttggcaaaatatgacccacgaaccaaatctggcccaccacctgctgttgtaaataaagttttattagaacacagacttgtttattaacttatatattgtctactgttgctctcatattatcacatgctacaagggcagaattgaggagttgtgataggtaccatacagtccccaaaacacaaatatttaccatatttactttttatagaaaagttttgccgactgctgctctccagcaaaaaacataatgagctattgttatagtcaacaacacggataatcctcacaaacaaaatattgagtaaaagcagccagatatcatggtgaacttactgtttgatttcatttatataaaattcaaaagcatataaagttaatctatggtaatggatgtcaaaaaaattacatttgttgggggattaaggtctaaaaggagcatgaggcaccttttagtactgcctctatgtgaataatggtttcatgactgtgtttatttgtgaaaaatgacttacaacttgtgaactttcctgtatatttcaaaaactttgcttacaaaagtaaaaaaaagaagttaatcaaaattaaaaatgaaggccgtttcaattctgttgagagttacttaaaatattttcaagattttacctgtctcttttaagggttgtttctactaatgatagaaaataaatgttaaataacaacaagagaatataaagccatagatactaaagacgaagcttattttaaagatgagagttataaactgaaaatgaacaccttacagtgagtgcctacttagctttatataaccaaaatatatagatgctactttttgtctacaaataatttttgaagttttctacctgttttctaaacagcatagaaaataaccctctaagttgttcagttactacatttcctacaataaaacacttaaacagcaaaaacgacaggttgtttttgaggttctttcactgatattcactctaccatatgtcacttagaatatttaaagttaattaaaatttattttctttctcagatttaattaaaagataccttttaatttattaatactaattatgcacttttctcattgactaggtgagcagaagtaaataaagtacatgacatttctaatttgcattattagaaactgcaacactatctagaattacttatctttttaaattatgaagtaacacagatataatcaagaacgatcaatcatctttggaaatccatatgaactgtttccatttgtgccctccctctctcacttatctttcctctttatcattgaatctttaatattactgaagaaatgtcacttaaaatatagcagaagcagctagaaaacttttttatggaatacaaaaatcaaatgataaattctcctttaatacattttattgcaaagagagtgttcgaaaaacagctcacagttgcagatgtatatctgatttcctgagattgacttggtttgtttgttttcaacttttaaaaaaatacacagactataaatataatttctgtatataaatagtgaaattgaaaagtgaaattcaatgttctaagcccttgaaaatccatgagttcttctaaaagaaggtattctgatactagattgtttaatgaatcaataacatgtcagaaggaaaatcaaataattatccaatcttgtggaggaagagtacctagatttatggctggaaggatttaggacagctagaaagttgttaacacttccacaacatgatccgaatacacacacacacacacacacacacacacacacacacacagtggcagatgttcaaatacagaaaactactgaatgccacatagtttttgaaccttgcagattatctatgttttctttttctcatccccctagaaaataactcacttttaaattgagttctaagccttcccttttgtaaatactctctgttataatttgctctcctaactataagttccaagaaagcagagataacatgtgtttgctcaatattatgttcccaagacctggcattgtacctaaaacatagcaggaggtcaatgaatatttatcatatgaaaataaataaatgaatgaatgaaggcatacaaaatcaatcctaaataactgcagatgcgaaaaacttcaaaaaatataaaatcatccagaagtgaaataaacagcaagaacagggaaaaggaagtttttgagttgcaggtcttgtttattcatcttcaaccacaagttaaattcaattagaaaaattaagacactaatgttagcaatggctgtttcaagatgataaagttgagcaattaatgttctttatatttgtagatgtctatcaaatattctacaataaagtttattattttatattcagaaaaagtgaaaataaaacaaaacacttattttagcaaatacttacttattgtctagtatatgttaggcattgcccagatgtctagatatggatatgagaaaaacaaggtccctgccattcagaactcaaatttatgcagaacacagacagtaaaatgaattattataagcagtataatgagtgctacaatcggtgtgttcattaaacactagagagaaagcaatcatctgtgcatatgtatagcagagtggagaggcctgagaagagtcacaaagtgggtgacctgtaaactgttttcttctaaattatatttaaagaaattactaaatgaactattatgtttagtaaaactgatcttaaaaccactgttacatttttttagtaaaattatgagaccttgagaacataactataaataaactaaccatttataatttaagtaataatcacaagcatgaagctagaaaagcactaagtatttatagatggaggagaaaagggattttccttttttcagagaataccaattttaataaaaaatgaatgagcttttataaatcagtagctccaaaacgttttcctttcagaaaatgatacctctttttttagtgatctcttataatagaacagtctgataatctcacaactttgccagaatcagatgaaactaagaggtaaatgttgcatttgttcattcaaacagaaacaataaaacagaatgagggaaagaaagaaacttatgttttctttatttgtcctgcttgtacatatgttttttttttaaatcccacaatagtggattagtttagaataacacttatctcctcttcctcttctggaatctttgaaatcagtgggagctgcacatacacacacacacacacacacacacacacacacacacacgaagagactgagtatgagaggaataaaaagcatcagccttttgaagccaaaactgcatttatatcaatgcccatgttaaatatactcagtttgaaagagtaaccttttgaatatttagctagttaatgagttaggagatttctgatttcaggcagtgactttctactttttaagtgcttaaataaaacaatctttgttttaagagtgatttttactgtaaatcaatttctgagtttggtgtaggttccaaactgtgaaactaaggcaataagatgatgtcctcattgctcaactgattaaaaataatgtttaatatttatttagtatattaaagctgtggctatccaatgtaagaaagtgatcaagtcatcttgcccaaggagcctattattgaaatgtgtctggtcttactctcagaatatcctgagtgattaaagtttaaataagctatgaattggagtgttttgagagtgaagagtcttcagtggcagggagtgttttggaaggattaccctctttaaatttatttggaaggtattgggcaccttccttatcatgtatgccaccagatgagacatctgcaagatgtttaccagataatctataccagataacaggtatatgttatcagatacattacaggaaaaatcatgaagagtgtgagagaagagattttaagggagacgaactgcataaatatatacttattctatagatccaaaaataaaatagattaaaactaaataaataaaataatatgcataacatcatcttcccaacctaagggtaaagatagtgtcataaaaatacttgggtccattcttctagattcaactataaattaaacttgtctatcagatatactaccaaaaacatttttattgaaacattatgtgatttgcagatgaaccgtattccccagctcttctgctggtaacagattttccaagatgtgttcaataatctgaattccaatgaagaatacttatagcaatctgcaacatagaggaaacgtctactatgaactcttattttagttgcctattaggagaggatcattattagtcttccactcttcagaattttgtgaagaacaggttcttctattactccagaatatcatgaagaacaggtccttctgtaatacttctaacacaatattaccctagtctcctctacccaaacttagaagaatgaacagaggcctggacataagtatatgtcataaaatgcatttttttaagataatcaggatttcaagtaagctacattttaaaataactgccatttttgtcagagtgaattggaaaatcaacatgcaacaagagtgaagatgcgaaatttaggaacaaagcattaagacctgtgccagaattgtagtttcttaaaaaaaaaagtgaattagctgtcacatcccagaaaaaatgttcataaagtaaactaaatctccaggcagtgagcaagtcttgaggggagtccctctcccattctgctccatgtatcaagagaaccattggtccagatccacattcaacagggacctcatctgccctcctttcactccactaggttccatcattgctacggggactacaaaaaggcattgtaaggtaaggtcatttattagctattcccatttctagttatttttattttatcacagatacatataattttgaacattgtgctgtgggtttttaatgttatttacagaataaagattttcattgctaacttgaaagagtaaccattatcacaattgcagcccataatcatgatagacagtttcctactgtaatttctctgcctcaatctcttggcttcatactaaactcaggtaccatttattacgcacctgctatacgacaagtgtgaggataaggtcatgagaatgtaggcttatgaagcttatattctttatggggagatggagaagataagtgaataggtaaataaagattttgtgataggaattctgaaggtaacaaaactgggtgatgctattcagcacagaaagtaagtgagttgggaggggaggaagacactccttagactaaaacatcagaaaagcctccctggaatgaaaaagtgacctgatttcgaagtgatgaggaggaggtggttatgggctaatctagagaagatgggggcaagcggaaagaaaatcatgagtgtattagtccattttcacactgctgataaagacatactcgagactgggaagaaaaagaggtttaatggacttacaattccacatggctggagaggcctcacaatcatggcggaaggcaaggaggagcaaatcacatctttttttttttttttttttttttttgtactttaggttttagggtacatgtgcacaatgtgcaggttagttacatatgtatacatgtgccatgctggtgtgctacacccactaactcgtcatttagcattaggtatatctcctaaagctatccctcccccctccccccaccccacaacagtccccagagtgtgatgttccccttcctgtgtccatgtgttctcactgttcaattcccacctatgagtgagaatatgcggtgtttggttttttgttcttgcgatagtttactgagaatgatgatttccaatttcatccatgtccctacaaaggacatgaactcatcattttttatgactgcatagtattccacggtgtatatgtgccacattttcttaatccagtccatcattgttggacatttgggttggttccaagtctttgctattgtgaatagtgccagccacaacaaacatacgtgtgcatgggtctttatagcagcatgatttatagtcctttgggtatatacccagtaatgggatggctgggtcagatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctagtgatagtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtactttgttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttcggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctggcgttatttctgagggctctgttctgttccattgatctatatctctgttttggtaccagtaccatgctgttttggttactgtagccttgtagtatagtttgaagtcaggtagcttgatgcctccagctttgttctttggctcaggattgacttggcgatgcaggctcttttttggtgccgtatgaactttaaagtagttttttccaattctgtgaagaaagtcattggtagcttcatggggatggcattgaatctataaattaccctgggcagtgtggccattttcacgatactgattcttcctacccatgagcatggaatgttcttccatttgtttgtatcctcttttatttccttgagcagtggtttgtagttctcctcgaagagaactcctacatgttccttgtaagttgaattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcaccttaaggagattttgggctgagacaatggggttttctagatatacaatcatgtcatctgcaaacagggacaatttgacctcctcttttcctaattgaataccctttatttccttctcctgcctaattgccctggccagaacttccaacactatgttgaataggagtggtgagagagggcatccctgtcttgtggcagttttcaaagggaatgcttccagtttttgcccattcagtatgatattggctgtgggtttgtcatagatagctcttattattttgagatacatcccatcaatacctaatttattgagagtttttagcatgaggggttgttgaattttgtcaaaggccttttctgcatctattgagatagtcatgtggtttttgtctttggttctgtttatatgctggattacatttatcgttttgcatatattgaaccagccttgcatcccagggatgaagcccacttgatcatggtggataagctttttgatgtgctgctggattcagtttgccagtattttatcgaggatttttgcatcaatgttcatcaaggatattggtctaaaattctgttttttggttgtgtctcttcctggctttggtatcaggatgatgctggcctcataaaatgagttagggaggattccctctttttctattgattggaataatttcagaaggaatgataccagttcctccttgtacctctggtagaattcggctgtgaatccatctggtcctggactctttttcgttggtaagctattgattattgccacaatttcagagcctgttattggtctattcagagattcaacttcttcctggtttagtcttgggagggtatatgtgtcaaggaatttatccatttcttctagattttctagtttatttgcatagaggtgtttgcagtattctctgatggtacttcgtatttctgtgggatcggtggtgatatcccttttatcattttttattgcatctatttgattcttctctcttttcttctttattagtcttgctagtggtctatcaattctgttgatcctttcaaaaaaccagctcctggattcattaattttttaaagggttttttgtgtctctatttccttcggttctgctctgattttagttatttcttgccttctgctagcttttgaatgtgtttgctcttgcttttctagttcttttaattgtgatgttagggtgtcaattttggatctttcctgctttctcttgttggcatttagtgctataaatttccctctccacgctgctttgaatatgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattaccctgtggtctgagagacagtttgttataatttctgatcttttacatttgctgaggagagctttgcttccaactatttggtcaattttggaataggtgtggtgtggtgctgaaaaaaatgtatattctgttgatttggggtgcagagttctgtagatgtctattaggtctgcttggtgcagagctgagttcaattcctgggtatccttgttaactttctgtctcgttgatctgtataatgttgacagtgggttgttaaagtctcccattattattgtgtgggagtctgagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaagtctgttttatcagagactaggattgcaacccctgcctttttttgttttccatttgcttggtagagcaaatcacatcttatatggatggcagcaggcaaagacagagagcttgtgcaggggaagtcccctttttaaaaaccatcagagacttattcactatcatgagaacggcatgggaaagatctgcccccatgattcaattacctcccaccaggtccctcccaaaacacatgggaatttaagatgagatttgaatggggacacagccagatcatatcaatgagaaaaccctggggcagctccatgcttagtatgacctaaggatagacaagcagcaagtgagtgcagagagcaccagaaagcttggcatgagatttaaaggagagagagaaaggtcacagagaaattatatagggcttttaggcctgaaattcaatatgttatgaagctattgatggattctatgctcacgtatggtgttatctaactcatcactctgactgaatgtgcagaacagattataaagagagcccagtatggaaggtaaggataattaagaggctctggagaggtctaggtgcctaggtgacccatgttggaggtttgcactgaggacaacaatggaaatggatggggtgcatccaagttattggttagagaacatccttttttaaggctttcatagatcccaaagcccttgcctctttttatacaagtgttgatggtgataaagaagggaagcgattattaaacagcaaggaaatagacagtatgttttatttttctcaaaaaaagtttgtgttaagcaatttgtaaatttatatcttttctttcttgtaatgctgtgagatattaaggaatattaattttagagatcaattttttcatttaaaaaagtctgataattatagatttttgatctaatttttacattgtgaaacataatttctccaaataacaacaatacaaaagaaaaattaagcaaattcacacacacacaaacacagagagagagaaagagagagagttgtggactgcatttttattcctatgtcatgaaagagccattatataacttttaatttatgtttatgtgggcttgaaaatttaaacattaattccttagatgaaaaaaatataaaaattattattttggagatactggtgtttgtgaacatttggcctttccatttttttcataaattcaaagaaaatattttagcaagaaaattaaattaaaacataaccatttataaatattctacaaagatttcaaggtgcaacatgttccaaaaataaactgtaaacaaccttgtcattacaaagctgacttctaaatccaaactgttgttctctatcttcttccaactgaataaatgaaaaacatatttagcagtgtctgtagctatcatattctcatgctctcaagaaacgaagtatgaaatacatgaaaacacacaaaagcaatggagtaatgaaaacttggtggaaaaaggaattagctattctggaaaagctagaataagaagataggaggctcttgtattcagtttatgaaaaggtataagatgaacaaagtgcccctgggtgcactggattaaaatcgtgaaaacaaaccatttacatgtaaaaggcaaaaataagtgtgtatcctagaataaactgaaatccaaccataaataaaaatttttctgtccactttttgtgtcatatactcattttattacacactatctttttttacactgtttatacatactaacttggaaataggagaaaaagtatggaaacatgataggcaaaatcctagagaatttagaaagttttcatttgaagagagaaatagcaacaaaaaatattataagaataaatgatcatcttgcaaactaatcttaaaggtagcaggcactcatcagtagcttttgccaccatgagagctaatattatctgtgatggtaaagcttactgggatttctctaaaggaacacagttgggactcgttcctagcaaaatgcagtatgctctgtgaaaggtaggggtccctccaaaggggattacatcctgccaaaaagctcatttgtatgagctttcccccctcccaggctccccagcaattctcccctttgcttggcaccatgcagcagcatcacgtgaatttttggattggctgattgagttcatcgaacatacagccttggcagtggcaattatcctggcagtgtcagaagccaggaaacatataccagtaaatggatctcattttaatcactgtacatagggtttgcttgatttatcccatatcataccaagctctaatgtggcagccaaactctttactcagttgccatgctcaacaaaatggttaacgttgaacttctattaccttgccaatgtatagttttctatggttatcttttcctttttgattgtttttctgacatttttgtttccttcccagttagggttcattaataaggttgaacaggttcaattttattcaattactagaaactatgtaggaataaagatgtttctgtttgaaccacaaactacttttaacaaaattttaaaagagaaactaaaaattattattccaaaaaagattagtagagtttcttgctctattaacttttcatgtaatccaatttcttttgaaaattgtggctggaagtttttattaagccccttggtgtctcagtaagtgcctgaacagagattgaaaaaagaaaggtcacactgacacttaacatactgtcatggtcttttcgatgtgtccacttggctaggctacagtccacagttgtttaataaaacattaatctatgtgttgctgtgaaggagttttgtaggtgtgattaaagactatagtcagttaactttcagataatcttagatgatacggggaacttgattcaattaattgaaaggtcaaaatcaccaccaaggcttctctcaggaagaagaaattccacatgtgaacagcagcttcacttgatgtgcaagagctccaccctctcctaactgatggcctgtcttgtgggtttcagacttgcctattgagcccccaaaattacataagccaattccttataaatctctctctctctctctctatatatatatatatacacacacacacatatatacacacacatatatacacacacatatatatatacacacatatatatacatagagagagagagagagagtacacattctacttctcaggttgagccttggttgacacatatttgggtaactagaagtgaattactactgtaataaatacctaaaaatgcaaagcagctttgaaattgggcaatgagaacattcgagcaacataacttttaaacactacctagattgtcttaaacatactattagtagaaatacagatatcaataactctgtggattaattactcagaagaaaatgaggagcatggaagagaaaagctaaatcaccttagagaatattcaaattttcatgaacagacttgtagtaaatatatgtatattctagatactcctggtgaaggatcaagagaaaatgagggatatcttattaaaaactagagaaaaggagattctcattacatagtaacagaaatcttagcagaattgtgtcctgaagtaatgtggaaagcagaccttaaaaatgatgaaattagacattcagctgaggaaatttccaggcaaagtgttgaaattgtgatctagtttgttcttcctgcttatcacaaaaggaaagaataaagagctaaattgagaaaagatgtgctaaacacaaagaaactaggccttgatgatttaaaaattctcaatctaccaaaatttcaaaagaccctataattaagagatttgccattgaaaatggaagttgcagaggaaaaaagaatcaagaatatggccaggcaacctttagataatacctcaggaagactaaaaagctaagtatttagtcacacaaagccttcttgaaaagaatgtgtgtgattcattgattccctcagtcaactaggcagaagccaaaaatagagatgggatctttcagaaaacatctctggaaaagattgttgtctactggagtgaatcctcatgacataaacagaaaaccaccaaaattcttgagaatttttataccaggaggaatactgccagcttgaattgaaagaaagagaaagaggataaaatgaaagaagtctttctgacccccaaaattctgcaggcaggaaataggtgataaaaccacccagcagcaaacccaggatataaatgatgactcacagggtagatcttcaagggaagagaatgaagcctcaaactcggactgcagaggctggaaatgcaaatcacaatcatttccagaattcgaaatctaatgtagtttgcctggctagatttaaaagttgtttgggattgatgactcatttttttcttatattttctccttctttgagaaggaatgtctgtaactactctcctatgccagtctcactattgtattttgagagtaaatatcttgttgtctagtttcatggatctacaaatggagaggaattttgtgtcagaatccaatgcactcatacctaatttaaattattttagtgataatgaaatttgggacttctgtgctgatgagatttagatgagattttggactttgagttgatgatataatgggttttgatttcatggacctttgaacagagtgaatgtattttgcaagggagattaggttaaattttgagggtacaaaagagaaactgtgataggcaaaataatgacttcccaaatgtatcctaatcactggaagctgtgattatgttattttatatggcaaaaggaatttcacagttgtgattaagttaaggacctcaggatacatgtattatcttggattatctgggtaggcccaatatttacaagggtccataaatgaggaaagatagggaaaagagtcagagggagatatatccatggaagaggtcagagtgataccatgtgagagatgtgaaaaggatttaattcagcttttctagctttaaagatagaaggagtctacaagtttaaaaaatgttggcaagctagaagctagaaaaggcaaagaaacagatcctacacagagactacaaaaataatttaatcctgttctaaaaagtttatttttaccctggtgagactaacatcagacttttgacctacagaactgtaagataataaagttgtgttgcttatgtgtggcaagaggctatactgattcattacccatggctaatggtttggctggatagtcaagtatttaaaaagaaacacaactgcaaatttggttacaacaaggtcttggagagagagatatatgaatagaactctcttagtggacacagaatataaagatatttatgtttcctatgaatgctcaccaaagggtggtttcaccagacaatgcttttaatacatagtttataagatggtctgttctgtggatgccaatgagcctctttccccactcatttctctgatttcacatagggttcacaaacaaagtggccatggtttcaaggatggaaattatgcatgggcttagcaatatagacttgcacttacaaaagattacatggctaatgtcatgtgtaagtgcccaatcagccatcatcagagacgaacactgagtctctcatatgacaccatccactagtatgatcagccagctgataggttgattatattggaccatttccattctgggagaagcagcattttgttcttactagaatagacacttattctggatatggatttgccttctctgccacaatgcttccaccaaaactaccatctatagacttatagaattccttatctgctattacgttattttacataccattacttgtgatcaaagaactcacttcagagcaaatagggtacaacaacgggcccaggctcatggaattcactagtcttaccgtcttctcttattttgaagcagctggcttgacaaagtagtgaaatggctttctgaaggcacagttacagtgtcaactatgtggcaacgtgacaattagttggagctaggacaagttccaggcttctgtatgtgctttcaattagcttccaatacatgattctctttcttccatagccaagcatcttagtctgttttgtgttgctataacaaaaaaccaccactgaataattttataatgagcagaaatgtattgactcatagttctggagactaggaaatctaagattgagaggccatcatctaatgagggctttttgctgcatcattccatggtaaaagagaaaagagagggtgaaagagagagtaaaagggggtcaaaattccccttttataataaacccattcctatgctaactgtattaatttattcattctgcacacgtggtctaatcacctctcattagaccctacctcccaacactgttatattgggaatgaagtttttcaacacatgctttttaggagacacatttaaactatagttccgccgggcgcggtggctcatgcctgcaatcccagcactttgggaggctgaggcaggcggaatcaccaggtcaggagatcgagaccatcctggctaacacggtggaaccccgtctctactaaaaatacaaaaaatagctgggcgtggtggggggtgcctgtaatcccagctactcaggaggctgaggcagaatagcgtgaacccgggaggcggagcttgcagtgagccgagatcgccccacccactgcattccagcctgggcgacagagtgagactccatctcaaaaaaaataaatacataaataaataaaattaaaaaaataaactatagttccaagattcacaggtacaggaatcaaacaaaataaatggaagtggcactactcactattacccatagtgatccactggcaaatattttggcttcctatccctacaactttatgctctgctggtctagaagtgttagttccaaagggagaaatgcttttgccaggagataaaataatgattttgttgatattgtcagagggccactttggggtcttcatgtttctaaatcaatatgcaaaaaagtgggacactctgctggctggtgtacagaggaaattgggttgctgctacacaatgaagttaatggaaatgtatgtctgaaatacaggagatacctgagggcttctcttattccaaccatgtcctgtaattaaattcaatagaaaacaacaacccaatataggcaggactgctaatggcccagaccctttaggaacaaagatttgggtccccagtgagcaaagaattacgatctgatgagttcttattgatggcaatgggaatatggaataggaagaagataattgtaattacctggtgtgacaacacaactagctggaaaaacaaagattatattatgagcacatcttccttattttgttacaaatgtttgtgtatacattattcaaatacttttttttgcttttatcactctcttgttccttcattatctataaaaagtgtatcaaaaagctaactttcaactttcccttcacaatactgaaatatataaaagaaaaaagagtgaatattcctaaaggactttacatcctcttttaaggcaagggttagtttgttctgggttgtacccaagaaagtttcatcatgttgggcaaaaatatgattttgttgttgtctctatttaaagattaaataaggtttaagatatgccttaagtagataagtgccaagttgacaaggagtggactgtgatggcctttttgtttggtctgcttggctagcctatagccactagttattcagtcaatacaggtattgctgtgaaggtattttgtgtatgtgattaaagtccacaatcagttgaaagtgaacattcttcaagaattgaataaaactgggtattttctgtaaattgagaaattatactagctgtctggaatgtaatttaaaagaaggtgagctgaagtgctttaagtgacttcatgcaaccctgatttattgcttcatgggttgaatgtaatgtggctttgaaacagagtagcagagaatgcctaacataaggtataggctgcaattattaacatgaagaacaaagtggttgagttcagagaagggattgacatcaataaatcagaaggagttgtttggaatataaggacagtagatgcatggaattaaaaatatgattttgctatggaaatttatttttacatacagcatgaaagataagtactgaagaataaagtagtaacaatatgcaataaagacagtgtacttaatgggctaaaaatattgtaaattagtgccagcaatgtggaagttagaaaaagatgatactaaggtaaatagtgtcttttaaataaccagtatctgtgtgaataactgtgaactatggccacccaaagagaaccactatcttagcattctattgctgcaaatgaaaaaactagtctcatcttgtcatcttaaaaattagaaaacagaggcccagacaaagtaccattgttagtggcatgagctatgtcaaggtggcagaactaatagaatttatgtttgtttgttttttgttgtttgtttcagttgccaagctaattctcaacattcttactttgagagatagcatggtatactggttaaccgcacaggctctcaacccacacacactggcttcaagtcttgaatttgtcatttataaactatgtaaccttagccaatgatatattgtttcctcatcttcaaaatggaaatgatgaaaactgtgtttatttcaaagggttattgaacataataaatgagtttgttcatttaaagtatttagaatagtgctaggcacaattgtaaatgctgagcagatgctagctattattgtaagaacaattctatgaaattataatggatagattttgaagttttaggttgcaatagacatggaatacctgatgatgaattaaaattctagtctcaatatctgcaaagctaaagtgaaaatatggattaaagagtaggatgaaggaaagacaatcatggtctttcttcattttgttgaattaaagattgtagtaggtcatccatttagaaagtcaaacacaagtgatttttttaaaaacatgaataatgggttcagacatttaaacgctatcaaataaaagaatttggccagtagaatagaagcttaagtcacttgttgtgtcttcaatgatggtgaattgagaaaaatacaagtaacatcttaggagttatttctatgatgggaatggttataaggaaatttctgaggagaaaccccagataagtagtaagaaagagagagtagaaaacaactttgtttcttcatggagggatgcttaataagcctgtgaactgctgataaatgtaaataatcatagcaggagagtcgttttggatacactatgtagaacgaagcagggactgggcgccatagcaccatattcaactactcaaatgaagagttgttagactaaagtagaccaataaaggcaaatataactcagatgaaacctctcagtggcatcactgacttttttagagcaactaaaagttaaatgtatttaaaatcctaagctctgtgacgaaatattttctggatacattgccatgagaatggctttttgaatgggtggagcggttgtctaaccctaacttaacaagaccccatatgtttttggtgtaggagttacatcagtgactcacaaaatatagttaaggaattaaccatttatagtgctagatactaggaatttttgtatttggctacataacatatttcctttccacaggaggtagttatgacaaattagaagtctgaaaattttctgatggtgtaaaggcccagctgtcactggggagttagtgatcagatttcatagctgcgtggtcccgtggcgccacggagagctccatatggtcacccaaatgttccagctaaatccactgaaaatttccaatctgagttttacttgtaaagaataaaactcttgcatgaatttatcattatgtgcctaccaagaagaaaagtcttgttagctggttacattttaaaaaatggaaaaaataatctatctaagaacaactttgtacagctgttatgctatcctcatgataaacagacaaagatgcactcctgggaactccacagaatttagtctacagcaattgtaatatatctagggtagggggactttttaatggatgtatagtaaataattaaaatctgtggaaacatcttcttatgataagaaacaattttatgagccactgttctctcattcgcccagaaaatcacctcggctaatttgttaatgtaattactatgtgctgtgacacttgtattcatgtcaaagatgtcagcttaagccttatctaataacaaatgacaaatgcataatttattgattcttaaatggctatttcttttgatatattccctataagcaatttgcttggaaacacatctggctcataaaggtaacagctgtttaaaagaaggtcagttttatgtcttaaagaaagaatacactaatcttttatttgttacatttctataccaaatcaggaaagctttatgttttgtaattccatttgggctttgatgatattaacaatataacaaaaatatttcactaaagtttccaactattaaaaatataggcattaactcaaatattcttttgtgaaaagttgtttcatttttaacaaaaggatccggtttacctaatttttataacaacacccagtggaccctgctaggttgaatatttgtttttattgaaatttaaatgcatgcatctgtcattttgttattgaaaaaaacaaaaatattattaagggtgcttcaaatatttaatatttctcaatttaaaaggttgaaccattaattcttaatcacataaagctgacatagctattttcattctttgtagtggttttcagactttctggatagtttcattcctcttctaaacataagaaattatcacctcttattagttatttcatcctttatgtttctctggtgaaaacaaagtataacttttgaaatacactttaaagatttttgaaatttttattttctttgtgtacaaagaaatgcacatagagaacagacatttttaaatccctataataaagagccaggcacctttaactttacatttcaccttgcagcacacacaaaatgtttaattatttgaggattaatggaggtagtttataattaagctgaagtatgaactgatgtcatcatctcagtatgatgatatacatttttatgccaaagcacctgttgttttggaaggaagcagctgatatcattatctgcgcagccagatagccctgtttcctgctgcttaaaaaattatcctaagggttacctaagttggagtaattcagcatttacgtttccatacccagaagaggacagaatggagaaaatgacttctccagcaaagaaagagaaaatgagagacacactgggaaaggagaagggagaggaaaaggagaacatcaatgtaggtgaccaaaggatactagaatggtctttgtaatttttctaagagcatttgtaagttgcaaaagaagaaagtaattgaagcacctaattaattttattaatgtaaatgaaatgttgcattgctggaggaagtggagtaaaaaatatacactttatactttaatgcatcatgtaacaaaccacatttctaaatactaagaaaaatgttttcatttacaactttagtgtgtacaaaatcaatgcaccactgacaagataccagtgacctaaattttcattttttcacatctagtacttaccctgcccctgaatttttttatttactggttggccttttggtctactgatatacattagttaggaataaaggtaacccataaatacaaattgccatgtaaacatatcaatcaacatactctcttgccctgtcactggcttcatccccaaattgggaagaaatctctaagtgtctcagtataagacaactctacaaagtctcacactgccaaaacatgtccaatatatattaactatatttattgatcccatgcatgtggaccatgtatgcttccatactcttctataaaaagttgttgcctagtcagtgctacttcttaccaaacagagttcttctcaacttagttcttactgtttattcctcattgaaactcactgccctaatcaataaagcccatcttccacatattattttatacatttttttcctctacacaggctatctcacatggtgcctacacactagttattatatctccaaagattattattgttgattattgagctacattttattcatacaaatatatgaggtaggtactattattgtattaagattgtacataaggaagctagacattatagagttaaagtaatttgcccctggtcatacaattagtaaatggtagagttgatatgcgaccttagtctgccatattaaagtatgttgtcttaatcattacatatatcctttctggtacaaccttttcaagtatactatttcctttccttaagtgaaacctgatttttctctgaagaccacacttacaaaacttgtgtcaggattgctcaactctcactttcactctttttctctcccactccaacactcctaataggtcaagggtcatgataagcagcctctttgctacctgctgacccaaatagtcacacacagttttctggtttttttgttaggcagctacaggaatttacctggaataatacagcacagatacaggtcacacagatactgagttcccagtcactcaatactcgtaacatcaatggcctatactccacactatttcagtcatcatgtgggcttcgtcataatggtatgcatgtaaaatttgaaattctgaaacactgctctaactatgagatattcaccctacatgtattttattctcatactccacttaccttgttgttcatcttctcataacttccagtttctcaaccctttcagagtaatttatttgatttctctggtttttaggtcacttatttcacttcccagcttgaatgcatgacccttgtggttttgcatttcaactattatcttactgccaccctagaatcccttactcttatcatcttttctctcaccaagtccaaatctggttatttattttatatgctttcattgttggagaatatctgaaagtcatgttaattggttcaattacatttcaggctatgtaatcttaatgatgcctattgctctactccttaacaccacactttttcgaaagttgaaagtgtcttcagatacttcaaacaatgatttcagcctgccgtgcttttaaaatggattgttctcttcaatgttcatgcatcaacttgcaggtacattttaggccctcattgtcttgatttctaagcaacatttgaaccttttcattactttcatctcttaaacttccatgacactaacaataaaatattgtggtacatgtctataatgcacatatttgtatttttttaatcctcactgatagtttctcctaatctttaggtagtattttacagataacagacgcaaagctaatacaaaccagcattttctacctattgctgatgaagggattttacacaggaagtgtcattattgtgcaaatggaagtcttgtgtcacatatttccataagtgagaaaaaatttttcccaacataaagggttcaaaaatccatcaataagtacagaattcaagatactcttttaaaaacataaagtacaataacattttatgtttcactcatcagatcaaaaattttgtaacgtactgttgataagagtgtgaggaaataagcaatccatttgtaatcgtgtacaacctctgtggaaagcagtatctttcaaaattaataatgtacatgacttttgacccagcaaatctaattttaggtaaatatttttaggtgtacatatcccttcaacataatggtgtatgtgcaaggatatgatctgcagctttgatagcaacgggaagacactggaaaccacctaaaagtccacaaattattggaataattaaatataacagagtattgtgccacaattggaaagaattatgtagcttttatgtaatgatatataaaattttgcaatatattttaggagagaaaacacggtacaaaagaccatacatcataaattactctcactttctctctctctccttccatacacacacacacacacacacatgcacacacacacgtacacacagagagagaaaaggagcaggatgttccattatagcttaacagtaagagtcaccagatggaaggtgaaactatgaaatgggagctggagccacggagcagcctcagttctgcaagagatgttgcctgagatagagaagtatcttgtcctctctccctttctctagcctcacagcctattacctgtgcattccactggctgagtccagtaggaaataagcacacgaaggcttggaaaatgaaacactcagggatcactccgctggatatacaaagcagaaatggattggaaggaaaataggccagctagcttttcctttttcttagcagccattcacatttttgtacccacaaataaattacatataataatgtcatgttttgtctaacatgaggcaaccattcattatataaactgagatcctcttgccctagctccaacattgtatctctctcaaatacagaatctacagaaaacttctgtccaggtgtggcacctcatggcgtctgttgacacaaggactgaaaatgtaaattaagcactattaacactccttaaacaaaataataagtgtatggggggagtgatttaattacatatatatgtgaaatatattaaaatatatactgaaatacatatgtctacctgtatgtatacacatatgcacatacacatacacacacacctgcataccaaagcaaacaatcacagctgcggaagtcctcagttctgaagataattataaaggtgtgattaatatatttatcgtttcttttccctctactcataacatattactgttactctcaaatcagttaatcagtactttttattttcaagagtgtctgagacctaaattccagaaggttttacctttattgtattggcctctataattagccaggaaagtaatctgataaattcgagggaatcctatgagttccaaatgtagtatttcttgctattattttacagcaacaatccaatatttccttgataagttgggacagtgaaccctactaatactagaatttctcctctgactgttaattgaaaggcataaagaaacatgcctctgaaaataaccccatggcagctttaacttctggatctattgtatcccatagtagacacttagacaagtttaaagaaactgaaagaaaaatgtctgtgaatgaattattaggtataatggtgagaggaattcttctcacttccatttcttgaacgcagaaactgtgaatgctggctgtgagagaactagcatcacataacggtggcagattcagagtataataccacatgtcataggagaaaacctcaacttcacctggtttcccatcaggtaccataactgtcttcagtgggctatccaccaggcctgctgcttctgggtattggtgtttgtggttaggccagagaacaccctatcagcttacttttgcatttctcttgcagcaaaatatgttcctaagtcaaaagcaatgttatacaggctaatatgatggtgcatagggaattctctaagtccataggtggtgctgctgacaggagtactgtgggcatggaattcaaattcatatcaagaatgaatataccagtaaggaaaaattacctttacaatggaaaaatttcagcgtaatccacctgcaagttgattgaccagtacctacagagaatcatgccataaaacactcaatgttagcatctgcagttcataaattaaagacttatcagagacaatataaggtcaaccttgataagagaaagtatatgctgactttgatattctaggcctgcttaccgacaatcttccaatcctgttcttttcaagtccctgaccaatgagaacaaacattaatcattgcccacgactcagtgtagaacttttcctcaagtcatcgctccttccacacaaaatgaacagctatatttactatctaaagtcatcctaagcacaaaaaaaagcgttgtcccactcccaaatgtgatttgtaaagccaatgaacttcaaatgaagtataacaagtaaattctggggaaaaaagtcaaccatggggaggttgacctttaccgctatcctctaggattacccctaagtgggactgtaacatggcagcagtccacctgcagcttgtgccagcatattgtacaaggtctctgtaaaccaagaccaaccatttctctctccatcaacaggtcatagaaagtctacatgaggccatagctgctggttaatgaaggagcagaaatgtaattttctgaattacagaaaaagtagatgtcatacaagtataagccaccttttcatggtatttacttgtgctttcaggattggctcaagcagttgctcaaatattatattccaatatcatttcacaatgtactacttctgaatatatgcaaccttaatataagataattttcaggtttctttctgttaaattataattctacaattccacaatttggaccatcatgtttggaagacctcagttatgtctgcatctctgctactacagaagatactcttttatggtgcctgtaacaactctctgattatttaatcttgacatgaacaaggaactcaaagctgtgagcctatacttgtctttctgtaagttcatcaaagttgtcagaaacaacgatttcaaaaacaattcttgaaatccttactgtgatactggtaagaagagtttgctacttgttttcccaaaaccttgcctttgactggcacttcatccagtaaatgataagctcacttaagcaatttaagccattgtatgccagctattagtaatatctcattttccacctgcacggagcttatgtttgtgtttgcactcaaatgggaagaaacacaatctaacaagcccattttgaaaggctaactcatgggattaatccaataataagaagtttgtcaatcaaggttcaatcagaaaaataaagtcataaacaaataaaaattaatgtgataacatagttagataggtgacagaagagactgagattcaaatcagggagtaggggagaaatccagagattaacaacagcagaaactgctttttgctttaggctgaagtggcagagagatcaggaagtattaacagaattcaggagctcatgtaaatagaagaatctgaattagaagcatctggagcaaaagaagagacatgacaacttcctctatactatctgaggcggagtccttgggtgactctgatatcttctttctacttgtttcttaatatttgacagaacttccaatagctaaatcctaatggaaaagagctatccctggagcctgggaagtgcaacctacaagagatctgcccacctataattcagcagagcaggaaggtgggcaaaaagtcacttctcttgtcacatctgggttttgaggccaacatgtaaaataataatctggtatggtaaaaaaaatgatcttggaaattccttaagttgcccataaggtgaagaatgggtctttaaatacaagaagtatatcagtatggagatatgctcatgccgcaagtgtttctagaagaacagaaatcaaccaaacagaagtgtaactctgtgccctctcccacccatgctctgggatgtatgtaaatggagtgaaataatagagacaataattaaatttttaaaaatgtgtacatggcctagcgtggtggctcacgcctgtaatctcagcactttgggagaccgaggcgggtagatcaccttaggtcaggagtttgagaccagcctggccaatctggtgtaaccccatctctactaaaaaatacaaaaattagccgggcatggtggtgggctcctgtagtcttagctactcattaggctaaggcaagagaattgctggaacctaattctctggttccagtggaggtggaggttgcagtgagccgcgatcctgccattccagcccagggtgacaacagcgagactccgtctaaaaaaaaaaatgcatacatgtatgatgtgactccactattctttaagtagttgtatgggcaaaacttagaattgttaataagactctgaggcaaaaattgaccaacccacttaatctacaccaaattgtatgaggcaagagatgtggacctagtgtagatggaatagactaaagacatctagaagttataataatagtaagcttgattgaagtttgtataggaaaactaatatataatcatccaatctactacatctttgaagataataaaagtgccactaacaattataccaggaaatgttgtcccagacaaactcagatacatcacatccaagttatgatgatctgtaaatgtaattctttggattagggaactatgaggctagtctgtgcattcaatgatgttacaaaattatgttaattttcttagaggtgatagtggtgtcatggttatgtaggaaaatatccttattctttagatatgtgtgtatactgaagtatttaaacataaagtatcatgatgcattcagctttttattggatgctttgacaaaaaggaaagatgtgtgtgtgtgtgcgtgcacacgtacatgcgcatgtatgtgtgtgtgcatgtttgtgtgtagaaagagaaagaaagatggaactagcacaacaatatgttaatggtaacttagataaagggtattatgtttctattgttctgtactttcaactttttcatgggttataaatatccactccctctcaaaattatattgcctagggaagaaaaagaggacaatatggtagataagaggaaaatacataatacatatttgaatatatgtttgtgggggcaatcacattgattcctagctcctccacacccctagtgattcagatttaattgacatgagatgagatcagaaacaatatatattaatgcctctcaaataggtttgagaaccattagctttgacaattaattatgtgctggtgacttttaagccatactcactgttcttactcctctcttgcactatagttctgcatttctagctgtctgatccatactttcttctgtagagctaccaggtccctgaaacttaaaatgcctccagacagtgttatcatcttttcctaccacccccatttcttccaaacagtttttatttctttgcttttctattttattttactaaagacacctaaattcttccaagtacctgaactaaaatacatcaagttattctttctctacctcccccatccaaccagcatcagatgttgccaatgccttcctcccaattgccatctccatcaccgccatgcaagacctcattatctctctcactgtaccactacaagagtctcatcgttggtctcttacttctattttatctctcctcaatgaatcataggcactgaaaccagagtaagcttccaaaaccacacctcaaaaacaaataaacaaaaacaccaaacttttgattataccctaatacctactaaactaaatgaaaatttcattttctaacttttaaaattctccatcatattatcccaacttaatattccaagcttatttttcataacaccagatacataccttatatttgagtaaaaattcagaactgcattttcatgatccatatccatattgaaattgttctttgcacattgttttcctctcttaactttctctttagaaattaactattctttaaagacaaaggcactccttcctacaaaaagttccttttatcttgtttagtaaattgccagaggacttcattaatatcaagcccactttctcacctttactattggattgaagttttgcataagagaaataccataagagttcagtgagttacagctgattctctaacaataaattaaactctagattttggaaagaataaaaatgggagaagttgtttggaaggtagaataggaggattgtagaaactgaccagtaaatgaaaattaatgctcccttttaatagactaaaccagcttgaaactattttaaaataacttgaaactgttttttattaaaatttaaattgataaatgctccaaaacagtgcacataaagctgcagctatcttgtgattctatcttatcattctaatgtcaatgaagaaccaaactaaatgttttctgtcattttttatgtcactataacctttggataaaattacaatcttatactaatgagcatttgaaaaaataaaaaggctgcccatattaaatacactatataaaaaattatacgtaatgaatatctgtataattatgtgaatacctgctaagtgtaaatatgctattgtgcttcaatctctaatcctgtgattgtttaaaatgcaaagagaaaggagaaacagaaatgttctaatgctttatctcaaaggaaaatgagatatgtagtttcctgtaggatttttgaggctgtaaaatatgatgtgttgtttctcttggcagcacaattattcttaacatttgacattccactcaaaataagaaatatttttctttatcttctgtccatatttatgatttaatttaacaacatgtcaaaaaagtaacaaaatcatacagaattcaaaatgcaaggtataaaagtgcaaaagagagaaaaagctgtcatccggaaatgaaagaagtaatagaccaaagagaaaatcagtgattaaaaatattcgtgttccaatcacttctcatgatgtgaaagacaaatattaaaaaataaatgaaaatctctactgtagaagtgaacagaagtaaaattattttatctaaacaaatttgtcataggaaatgaagtatctagaatgaaaagaatttcaacagaaatcatgaaggtcataataaaattcttctaaaaatgaattaatatgactataatatatcacgacatatttttattaaaggtatacttcacaatatatcatattatttctatttactacttaattagttttctttgtaaaattttctttagtgacttttatatatttgttttaaaggaataaagtatttaattatgtatttcttttcttaagtgaaaagtattctctcagtagtaagagataagtttttacactttatgtaaataataacatacaatttccttggttacttaaataagtttttcttttttttttttagatactaatttttgcattgcttttttttcaaatcactattcctttctgttgagaaaagtatggcattgtagtgagtttctaatttttttcctaaataattatcatcatattttcctctacaattttcctcaactataattaggtttggtttgtatgcatactttacaagattccaaataaattttttcttttaatttcttcaaaagactctaatttttgtcttattccacattccaccatcagtcatgaaatatatttctggctccagaatcatcacgtttcttataacatacattttaaatgctagggtctctaggaagtaagttaatctgacactgaaaaatacattttatatatgaataagcacatacaccctaagtcattccttcctttcacttacatacccacatccttttagtcaataatcctattggctctgctgtcaatatgtctacagactccatccacttccagctatttctaatgtagaagtggatgtagagattatcagcaaatgtagagatgttagaagtggatggagtctgtacacatattgactcctttctaatgtattatttctcacctgagttatcatcacagttctccaactggtctcttgcctctatctttggcccacctttcctctctctgctcttcccctccttttatagcctattcccaaatactgtcaagctataaatcaaaatcctctccattcttaccattttactcagagctttagagccaaagtcttgccctttgcctaaactgcggtgcatgatttgactcccattgcctctctgacctcatcacttaccaatcttcccttcactctctctgctttatccacacaactccttgctctctctgtagcataccagacttgacccctgctttagcatctaaagggataacccaaagtgttttatcctcatcgagttcaacagaacatgatatgtcactacaatagctttttttctcatatttgttcagaaaataggtattgaactcctcctatttgccagatactctgctaagcttatgaaatacaaatatgcaaaaagaaatcagtttccatacaaagcaaataatctagcaaaggagataaacgctatgatagagataagcaaagggagctatgagcccagaagaggatatatcagtatacattgtagacactccagcttcagagaagagttcagccctgaagaatttgtaaatgttataatggttaagaaggaattcagaggggatttcagccaaggaataaacaaaggcacacaattagtagaaaatgggatcagtttggagaactgcaagatagaccctgacattttgagctagagtgctaactagagatgtccaatagacagatggatatatgagtcataaactctggacagagattaaaaaataaagttgagatatagatttgggagtcatctcaaaatggcttttacaaattaattttaatgtaaataaactaaattgagtgagaagccagatcagaaaagagattgtttagtgaatcaaactaaacatgattattacaaaggaaatcctaggaaggagccctggggaccatcagaatttaaggcaaaagcaaggaaaaatggacccataaaggaaggtgaacattatggtcaataaaagaaaaccagacagcactacagaagaagaaaacatttcaacactgtcaagtgatacagagaagtcagaggtgtaagaattctattagttgaggagttttttgttggtcttagctaaaaagattgttcagtagtttgattgcctctaaagccagattataactcttgatgtgtacataagtgatgttagtaggaggcggcagatacttaacgattgcaaatacagacatgaggtggtgggctatgaaagggaataaaaaacagaatgctcactgaagacagatgtgcaataaaggtagtttttttaaggtggaagaaacatggatgcttacatttgaatgagaagtatccagagaaaaagaaattttgaataataacaacaatagatagcatttatgtcatgtttactttatgaggagctctattttaagtactttatttgaaataaattattcaacactagggtgaatttttgtcctcctcacttaataaataagaatacacaggcaaatacgtgattaagtagttttcacaaagttgcacagttagtaaataagcgagtcagaatttcaaaccaggaaatatggctttagaattttctctttctctctctctgaaggtacagtagatagattaacttcaagggatcacttcacagaattaaggatatgattgagattgaagatagataatgagtttaaggtagaataatctgagaacacccaccactcttctcagggaaaaaacatgtgactcccagaaagatactatgtaagtatggctctcctcatttggaagattcaaggaaagaattcagttaattaatttaagggagaagccagataagaaaagaaagtggcatacatttatgtagtaattcatggattattattattattatataaggagcagacacaaagtaatgggagtaggtagaattttgtttatccaatcaactatgcagtctaaaaaaataaagctcattgttttggtggcaaattacatttttaaaggtaatttagcagccttcaggatccccagaatacagttgataggtagctccactcagagccatcttaagcccaaaggagcaaaaattccaaggaacaagaaggaataggggatggcatcccattgttctgtgggctcatgtattgtattctaatgtaatcatctgggatattatcttaatatcacaaaaatatttatttaaaaagactatagattgattaattgatttcacaattgattttacaattaatctatggtctttaaaataagtattttataatattaagcattgcgatggttaatattgagtggcaacttgattgaaggatgcaaagtactgttcgtgggtgtgtctgtgagggtgttgccaaaggagattaacatttgtgtcagtggactgggaaaggcagacccaccctcaatttgggtgggtaccatctaatagctgccaggatggctcaaatcaagtagacagaagatggaaagagcagatttgccgagtcttctggacttcatttttctcctgtgctgaatgcttcctgccctttaaacatcagactccaagttcttcagcttttggactcttggacttacaccagtggtttgccaggggctctccagctttccatcacaaaccgaacactgcactgttggcttccctacttttcaggtttgggacacggacaggtttccttgctcctcaccttgcagacgacctattgtgggacttcaccttgtgatcgtgtgagtcaatactccttaataaactcccctttatttgtacatctatcctattagttctgtccctttagagaaccctgactaatacaagtataatacttattgtaaaaagatttgaaaaatatgtagaattgctcataaaaaattcatgtgtaatcccaccaaggagtgaaaattctaaaactcttgggatttatgtgtttctaatattttacagatacacatatgcccatgttcaagatcacataacatagaaaatctctaaatcccctgctattacttacttattaattatcagatgagtatggtctaatataatttgaaagtcttttaaaaccttatttaatgtctatttaacatcttattcaactaatagtctataatttatttggccattttctattgtttgccattgaagccattttaaattttgtgttaatataaataacccagcaatgaatgtctctataattaagattttatttttaatttttttctcagatattttcccagaagaaaactattggattaataaatttgagctttcaaaagtccttaatgtatttttctaaatctttttctagaaaaactgacaatttaccctccaccagagtgcatgagagagacttctttacctattgaaggaggagaccatttattatctagagaaaaaacaaacaactttattgattgcttgtgaatgggagagatgtacttatttatatattatagtcactctaagcaaaacaagaagttagaggaagtagttaaagatttgacagattttcagaatggggaggtttagggactggatgagtttcattcttgggagcatggttactggagttaggctgttgtcgattagctaacattcaaacatgtggcattgttatccattgtctgactttcagagccatgaatacggatccaaagcatctgagtaaccgaggtaagattaacctctattctgctttgttacctgaccaaagtttaggattatggtgaataaactgttcattttgtcattatttggattttgaaagtataaaatttttgttttacaccctatctctaacataactgagaattatattttaaatatctgttaaaggtaaaaaacaagtaagatctcattgaagttctaaagtggattaataatgaggtttaatttttttatatgtttcctttcctaatgcctgtcatgtacaagtgtactaggggatcctaagacaaataaggcctataaacattcacatgacagttggaaaatctgggaaataatcagacaattgctatagaatgtgctgagagttgccatggatctaagttaaggtgggcaagtgcagaagaagggcatgcttctcacgggagataacgcacgagctgagtcctgaaagccagagagccagctacaaggattcaaaatggagagaatgtgtgaaacatctgagagttctaaatagttctgcacagacagagcagaaagggtaatcattagtgacgaggctgcagaggaaaatatggatgtatttatagtgtcacaccaagggaaaaaaagtgtgaagattctgtcagactatatagttgactatgtaattgtctagctgatagaatgtgggagaggcagaagtaaacggagtgaaatcatttacactcggatgactcctagtttaccgaagtagactagagaggagatgctgcatgcacagacatagggagttggaagagaaggagccttgaggcaggatggaggataaattcagtttgggacatgtggcatttgagctgcctgaggaaaatataaaagaggttttctcctctctgcccttacccacaagtccttccccctagagtcccctccttgtgccttctcactctccaaatcctacccaagctatagccaaagtttaacccattagtcataataatctttgcctacctgaattcagttgaaacatttgcctaaaaactatttaaataacacttatccagacatatgagttttgtcctctcaaaaaggtgctcttaccttgttgtatggcccctgtatgagacaggatcaacataatggacagcaagtctgttggctacttggatttcaataaatggcaaccagaaatgaacaactcattgagtgaggtaaaaaacaagttggaggctgatttgaggaaagaatgcatgctttggggaaaatatgtacttattactgtaaattgtttagctcagtcacagtgagtgacagctgagatgtgatagagtagagaaagtgttttcctagtaaagggtgatgagctgtgttgggttttgtgtagatggtatgccatgaccatattatattttaatagatggaattccagggtgtgatcactgccatggtattgtacattagtgacttatttgcttttatttgtatgtaagggaagagcaccttcctagagattaatagacattgaaatgcatagatacaaggtttgattattactaaggctcccttttccccctgccttacaacataataaagctttaatctaaattaggttttcaaaattatacgtaacaaaagaggaagacacataagctatgctgacattcagaatatacagtaattgcccagggagatgcactatgcctgtagctgattaatcataagctttgaatatcatttagttatttcatatacaccacccaaaaaagtatcactaatgctttaaatgatactcatgtagcaactgtcattgcctaacaaatgaaacagacagatgtgaacagtgataacaaagatgtatatcttttttctaaatcaaatagcaccttcttagagataatagtttagcaagaaaaaagaagtgcgaatgaacagattttttacacatttaacacaatgggaaaagaactgtatgtatgcatgtctgatttttgtgatttgactcaaattaaaatcactatggggtcaggaattaaaaggagcccagttcacagtagtatggattagcaattctaaaattgctatctgtggatcttaggattgagcatatgagtgagtaatgctgagaaaaatgaaagccacattactgccagttggagaatggaattagaaatataaaaagaaaaagataagaataacctctgttataataaatttaaatggaagtaatagtatgcatgcatagattttaatatatgaataaaattatagctattgataagagatatagatatggatatatgcatgtctatattttgtagttctttctattaaaagggactaaaaataaagatgcctgtatagcaatgagcaaacttatatctcatatattagtttcccttttttaatagtccatgtttctttattatagtaaattatacataataatttatgtattatgtattatgtattatgtaagatgatagataaaatctatcatcttagccacttttgagagtacagttcagtgatgttacgtacattcacattgttgtacagaactttttcattttcccaaactgaaactttttacccataaaacactaatgccccatttccctacactacccagcccctggcaaccatcattttacttttacatgttagtttctgtatactataccctactaacagaagccagagctccatagagaaatgaatgagtccacagctatggcagtggagtacgagacctgtctggaacatatcattgtgatataaagcaaggatattttaaataaaataataggaatatagcaaaaggacactggagacagattgaagtggctctcacttgacaaatttcagacaatttcatgaaaatggataatgggactaacagactcttcctgaaacaaaataataatctatgattattactaatatattactaatatgatttactaatatatgtatgtaaacaaatatatacatatatgtatagaggtcctccatgagggtcccacccctgcagcaaacttctgcctggacatccaggcatttctatacaccctctgaaatataggtggaggtccccaaactttaatttttgacttctgtgtaccctcaggctcaacaccacatggaagctgccaaagcttggtgcttgcaccctctgaagcaatggcctgagctataccttggcccttttagcccttgatttagttctcagctagaatgttattggtgtaaagaaatgctactgacttttatgtattgatttatcctaaaacgttactgatgttactaggtccaggagccctttggcagcatctttagagttttctagctatagagtcatatcatcagtaaagagaggtagtgggactttaaatctttttatttttctatttggatggcttttatttctttctcttgcctgattactccatcaaggacttccagtactatggtaaacaagagtggtgggagtgggcattcttgacttgtttcagttctcaaaggaaatggtttcagcttttgcctggtcagtatgatgctggctggatttgatatagatggctcttattatttggagatatgttccttcaatgattagtctgttgagggtttataatatgataggatattatattttattgaaggctttttctacaattattgagataatcatatggtttttgtattttaatattttatatggtgaattacatttactgatttgcatatgtggaaacaaccttgcatcccagaaataagcctactttgtcatggtgaattaattttttaatgtgctgttggattaagtttgcgagtattttgttgaggattttttatgactatgttcatcaggggtattggcttgtagttttctttttatattgtgtctctatcagattttggtatcagaatgatgctgcttttctagaatggttaaggaagagcccctcatccttgattgtttggaatagtttcagtagagttgataccatttaatccttgtatgtctggtacaattcagttgtgaatccatcttccatctggtccagtgatttttgtttgtttgtttttggttgctcagttttttattactgattcggttttgaaacttcttgttggtctgttcaggtttttcttcctggttcattctgggaggttgtgtgtttccaggaattacccatttcctcttgattttctaatttgtgtacatagagtcattaataataatctctgaagatcttttgtatttctctaggatcagttatgatgtcatttttgtcacctgattgcacttctttgaatcttcacccttgttttttgttaatctaggtagtggtctattaataataacaagctcatgattttattgatcttttgtatggatatttacatcacaatttcattcacttcctctgtaattttagttatttcttttcttatgcttttttttttcctagttcctctaggtgcaaagttacattgttaatttgagatcattcttacttcttgatgaagacatttagtgctataaaccttttaacactgctttgaatgcatcccaaaaatcttggtaggttattctctattttcaataatttgacagatttttaaaattttgccttaatttcattttttcacccaagagttattctggagcaagttgtttaatttacatatcttatgaagttttgagagaacttcttggtactgatttctatttgtattgcactatggtctgagattgtgcttggtataattttaattttttgaatttactgagactcttcttatgactgagcatgtgttaaatcatagaatatattgtgtgtgtatgagaagaatatattctgtagtttataggtggaatattttatacatttttttaggtccaaatggtcaagtgttgagtttaagaatttatttgttagttttctgctttgatgaactgtctaacattgtcagtgggatgttgaagccctttgctgttattgcagctttctaaaaatttgtataggccaagaagaacttgctttatatatctgggggctctaatgttgagtgtgtatatatttaggacagttaaattttcttgctgaattgagccatttattatgtaatggtcatccttgcccttcgtgattgatgttggtttaaagtctgttttatctgatttaataatggtgacttgctctttgtttgttttccatttgcatggtagatctttctccacccctttactctttgcctatgggctgtcattacatgtgagatgtatctcttgaatacagcatacagttggatcttgtctttttatccaacttttcactatgccttttaagtggggtgtttagaccacttacattcagggttattattggtacataacatttttatcctgtcattatgttaatagctggttgttttgtagatttgattgtgtaattgctttatattgcctgtggccatgtctgtaagttgattttttggtagctagtgtcaatccttcattttcatggttagcactgccttaaggacctcttatgaggctggtctggtggtaataaatttccttggtgattgcttgtttgagaagtatcttatttctttttcatatatgaaatttagtgttgtgagatatgaaattcttggttggaatttcttttctttgaggatgctgtaaatagccccccaacatcttctagttttatggtttctgctgagaaatccagtgctagcctaatgggtttctctttgtaagtgacctgatctttctttctagctgcctttaatattttttctttcactttgaccttggagaatctgatgagtatgtgacttggtgatagttgccttatataatatgtcacagggtttgtctgtatttcttgaatatgcatatcagtctctgcaatattggaaaaattttcatggactatctactcgaaaatgttttttaagttgcttattctctctcctctctcagaaatgacagtgagtcacaaatttgtttttttacataattccactttcttggaggttttattgattttaaaaattattttttctttattttcatctgacagagttaatttgaagaactggccttcgagctctgtgtctctttcctctgctcagtctatctgctgttaatggttccaactgtattatgaaattcttacagtgaatttttagttccagaagtttagtttgcttctttcttaaaatggctattttatctttcagctcataaatcatttcactagattctttggatcccttggattgggtttcgactttctcctcgatctcaatgagctaccttaccatcacattctgaattatttatctgacatttcaattatttcaaactggctaagaactatcagcctggggggataatgtgtttgtccaaaggtaaggagacactctggctttttgaattgccggagttcttgttctggttccctttcccatctgagaggtctgttgtccttttaactgtggtgtaggttgagtataggtggcttcatttctaggtgctttcagagagataaaaatatggaacactttatgaaagtccatgtcatctttgcacaggggccattctaatcttctctgtatcatcccaattttagtatatgttctgctgaaacaagcactgaaagactatttgaccatatatatgtgggtttaattcttggttctccattctgttccactgttctatttttatactaatatcatactattttaattattgtttctttatagtaagttttgaaatccagaagggtgatacttcaagctttgtccttcctgttcaaaactgttttggctatttggagtcttttgttattccatatgtatttcagtataatttttttatttctgcaaaaaaatgatattttgatagggattgcattcagttggcttgagtaatatggataatttaacaatattacatcatctactccatgaacataagatatctttctatgtgtttttgtcttttactatttctttcagcaatgttttgtaattttcagtgtccaagtctttgtctcctttgttaagtttattcttaagtattatattcttttttatgcttttgtaaaaataaggttgttttctaaattttcttctcagatagtttgttgtcagtgtatggagatataattgattttgttgcacattgattttcatattctgcaactttgctaaattcacttattggttcctttaaaaagagagagagggagagaaagagggagagagagatgaggcctcattctgtcacccaggctagagagtagtggcacaatcttagctcagtgtagtctcaaactcctgggttcaaacaattctctcgtttcagcctcctgggtagctaggattataggcatgcaccacactgcctggttattttttttaatttttttaatttttatttgtgtgtgtgtgtgtgtgtgtgtgtgtgtacagcctggctgggtcttgctattttgccagtgctggcctttaacttcgggctcccacgttagcctctgaaagtgcttgtcttacagcctttagccactatacctggcctaatttattaattctaacaaatttttgtttgtgtagtctttaggattttccagatataagattatgcaatctgcaaacagagataattttacatcttccattacacttcttgtaaggcaggtctagtagtgccaaataccctcagtttttgtttgtctaagaagtctatttctcttctttattttacaatgacagttttgctgattatagcagtcttcattggctgtttttttttccttttaacatttcaaatatattatccctctgtttctggcctgcaaggtttctgctgagaaatacacttatagtgttcatatgattgagtaatatcaaatgactgtcttcaagtttactggttctttcactattgaagctctctattgagttttttggtgcagtcattgtgttcttctgttcctgaatttctatttggtattttttaaatatctcttcagaaaacttcttccttcattcatgtattgtttttctgattattgtttagttgtctatctgtattatagttcactgagcttcttaagattattttgacttttttttgtcttgcagttcatagctctccatttatttaggattggtttctagtgagttattttgtttctttggtggtgtcatgttttcttggttatttgtgatccttgtagcatttcattgacatctacacctttgaagaagtagtcacttattttaaatctttacaaactggctttatcaggaaaacttcttcaccagccagagattctgagcaggttgcctcgtagggtctgtggatgggcctgctgataggtttcacaggtgagcaggtctggtgccttaatctatggaggccaacctggttccaggatccacttggacaagcgcagagccaggatctgtacaaacagccctggagcttgagtccacagaaagcaggctttcaaagagggtcaactggagcaagcctggattctgggtccataggggcaaatttggaaactttgatctaccattttctcattgtttcaaaagtttaaaaactatttcacattattggatttccaataaagaagcatagatttaagagtattcaagttcctgaagtagctagaaccaaaacataactatgtcctctatattatatgttgacagaatggctactgtagtaaaattacgctgtataaatgttattttactaatgttactagtgtctaagatagaagagcatctaatatatttttgattggctgtttgaattgtattttcaaaataattataaacattttaatcattgttcaaatatgtggttttagtattttataccaataaagtaaaaatataaaaatattttagtagtttagtttctatttaatttatataagaatggttcttatgtcataaaatgtgtaggaatattcaatataaaaggattatagtaataaactgtaccaattctgaatattagatatttcacaaagtactaaaatgagtggcagctgctcacatttgaagataatgctcatgtcattaaacaaagatgtcattctaatttaaagttatattaatagaagattaaacaaaatccagagcatcatgctgaaaatagcattattaaattgtagaaatttttaccattacaaatgtgtttgacacaaatcaaatattttctgtttagtcattacaaaataagtgttaactattaggacctatgacaagaaagcctaaaaattaggtagaatttattatatttatatgagatctggctcttaaaattgaatttcaatgattttaagatcatattaatacttagcattctttaaatatttttacttttaaaaatataatttaggccgggtgcagtggctcatgcctgtaatcccagcactttgggaggccgaggcaggtggatcacaaggtcacgtcaggagttcgagaccagcctggccaatatggcgaaaccccgtctctactaaaaatacagaaaaattagccaggcatggtggtgcatgcctttaatcccagctacttgggaggccgaggcaggagaattgctcgaaccaggaggcagaggttgcagtgagccaagatagcaccactgcactccatcctgggcgacaagagcgagactccatctaaaaaaaaaaaaccataatttagtccaagatgaacctgcgcaacatattaagaccccaactctacagaaatattttttagaatttaaaatttaaaaacctaaaaaataattaactaatgaaacttaaaaagtatgcaaaatatttaacagtgacttcataaaataatatatacaaatggaaagtgttcataaagatgtggaataactgaaactgtcatacattcataacattgaagagacactttcaaaaacagtttggaagtgtctaaaaaggcaaacataacgtgtagcatatatggtaaagcaatcacctatgcagctatttatccaagaaaagtgaaaatgcacattaggaaaagacttgcatttatagttttttagtatcttaatttatatcaaaaactggaatcaactcaaaaggccatcaactaatgaacagaaaaacatactgtggtacatgcatactgtgggattttacccagcaataaagaggtaaaagctagtgagacactgcagcaacacagataaattacaaaaccatcattctaagtgaaagaaaccagactcaaaagacaacatatgaacaatttcatctatataaaattctttaaaagtggctaactatattaacagaaaacatattgtttgccagggtttaaagtcacgggagaagatcaactgcgaagaggaatgtaggaacttttttagatgatgtcatgtttaatatcataatcttggtgagaattacaagactatgtacatttgttcaaaacttgtcaagtactacctcaataaaccttagttaccaaaattgcttatcatggaaataatgtaaataattcagaaatgttggatatattttttatttgataatcatgatatgctatgtgtctttttctttcttttattatacattacgttctggggtacatgtgcagaaagtgcaggtttgttacttaggtgtacacatgccatggtggtttgctgcacccatcaacctgtcatctacattaggtatttctcctaatgctatccttcccctaaacccccaccccctgacaggccccagtgtgttcccctccctgtgtccatgtgttcttattgttcaactcccacttatgagtgagaacatgtggtgtttggttttctgttcttgtgttagtttgctgagaatgatggtttccagtttcatccatgtccctgctaaggacatgaatgtatcctttttatggctacatagtattccatggtgtacatgtgccacgttttctttatccagtctatcattgataggcatttgtgttggttccaagtctttgctattgtggagagtgctgcaataaacattcgtgtgcgtgtgtctttatagtagaatgatttataatcttttgtatgtataccctataatgggattgctgggtcaaatggtatatttctggttctatatccttgaggaattgccagactgtcttccacaatgtttgaactaatttacactcccaccaacaatgtaaaagtgttcgtctttctctacatcctctccagcatctgttgtttcctgactttttaatgattgctattaagtgtctttctagatgttcatcagaattcattctttctgtctaacacagtactagaattacaactggaaaattgttgcctagctggggactgttttttttcagattctctgccatggtcaggtgattgagctctatcaatagcatgttaatgaaaataaaatttgcaatgtctgtttcactttattaaaagtatttacctttagttttcactctttgtccctactctctggaatggggatgactagaaagaccttaaaaaccatgtatataagatggtgtagttactgctggcttctgtgaaatagaactactaattcatcacaacgattcatatttgactgattttgaataagaaatgatttctttgttctttaagccaatgagttctgggagtttctttcttattacgtagcctattctactcaaaaatcacttttcttaatggaaatctctcctctgatagtatgaactctcaaataaagactaaaaaattccatcacattccacttactaaggatatgagaaatagaatctttgtcccttcattctatttttgagtaataacttctatcttcttaaaagtgtgtatcttcctttgatatttatgtcatgtgtttatgttagcatctgcttttcctcatcagagagagctgctaaccattcttttttcttcagtaatgaaaaactttttctatgtttaggtctgacatcaacatagtcatcttaaagacttgatggatgatgtaacaccttggtttcatgaacttatttccattttttaattagtgaatgtatttatttcaatagtttttggaaaacaggtggtttttggttatatggataatatctttagtggggaggggtgatttctgagactttggtccaattatcttttaaacactagttctgcctccactctgaaaattcttactagcctcccaggttccagcgattctcgtgcctcagcctcctgagtagctgggattataggcatctgccaccatgcccagctaatttttgtattttcagtagagatggggcttcgcaatgttggccaggctactctcaaactcccaaccccaggtgatccacccatctcggcttcccaaagtgctgggattacaggcctgagccacagcacctggcctaaccaacatatcttgatctctgaaatcattaattcataattccattatctcatttattttcttcacttcctccattgtttgcttaatcactggtgctacacatgttctatctcatggagatcacattctattagccacctcatgccttcatgtcctttatcatcccagtttaaaactgagggtccatcatttcaatcattctcttgcttcttccccaatctctcttgctactttgcgacctcttagttttcatataaaaatatttccaacttgcatagccgcatttattcatgcagtaggtggatgctgattaaaacaaacaacttaacaaattattaccacttaagctccaccagttcctgaaacattacccactaattccactgcatctctctactccctctgctattgtggtaagagtagcaatggtggttaagatgctttgaatagtttttctcatacctgcagtaaaatatcctgactaatgaccattctcttacatattagtaaattttctgttgccatagagtctaacataaaaatacattgtacattagcatacattatacttgttctatacattttcaatgtctatgttgcatattgctgatccaaatctcaaacatttaaaatataaactgacataaaaagaccccatgtagaatgtcaatggaacagatttaaaaatctagcagaaaactttgcaagatatatgcaatatctgcacgaaataacatgaatactaagggacactaaagaagaaatatttaatgcacacagatgtttatatgttgtcaagaaaactcaacatataaagatttccattcaccttaagtaagttttaaaactacctaatatctacaaatttaatgtgatttcattatattttaagagaaaggagaataattaaactgacccaaaattgtatgtgaaaaaaatagcaagaaaatttcataaagagtattgattgggaattagatacccccaatgttatatcatacaataaagctactataatttaaaaattttagtagtaatgtatcattgctcatatgtagtcaagagagaaaaagtttacataaagacacaaatgcatacaaatatttagtatttaaaacaaatgaatttcacattagtggggtgtattagtctgttctcacactgctatcaagaacctgatattgggtaatttatagagaaaagaggtttaatcagttcatggtttggtgggctgtacgagcttctgcttctgggaggcctcaggaaacttaattatggcagaaggtgaagaggaagcaagcacatcttcacaaggctggcagaggcgggaggggcagggctacacacttttacaacaaccagatttcatgagagctcactcactatcacaagaacagcatggggaaagtccactcccatgattcagtcacctcctaccaggcccctcctccaacactgggatcacaattcaacatgagatttcggtgggaacacagagccaaaccatatcatggggaaaagacagtgaatgggacaactgacatcagaaaagaaaatactgtatctttatattataacttataactgttgaatcatagttctggaaaattattttacatatattctcaaaaaatgcatgaaatttaaaaggctatgaatcctgctattgaaaatagcctaagactagaaacaatacactaaaagagaattagtaaaataaattattgtacagttatttaacagaatactacagaagcattaacaaaatgagaggattcctaatgtattgactgagaattttcccaagaaatattgttaagtaaattaagtgattcagagaatgatgtacattgtatactatcatctgggtaaaactattgcaaatttttccgggaggggtggaattaaataacttggatatcagccccaataaagtgtctaatatatacattcaatatattcttattgaatgagtcaataaacccaataccaaagtaagactgtcaaaaggcaatgtagaaaacataggattgattaaataaatgagaaatacaggcagtgagtttaataatttatagaaaacaaaaataatttcgtataggagtcatttagaaagccttcatggaaaaagtaaatttttaaaagattacagttttctgtaaaactttgcatacccttccatgtctgattgctttggctaggacttccagtactatgttgaataacagtgatgacagtggaccttcttgtcatgttctacattttagaaaaaatgctttcagtatttccccatccagtagatccacagatctagctgtggatctgtcacatagggcttttattatgttgacatacattccttctattcccagtttgttgagggctttttatcatgaagtgatgttgaattttatcaaatacttcttcagcatctattgaaataatcatatggttgttgctttaattcttttaatatgatgtatcacattgattgataagcatatatcgaaccattgttgcatccatgggatatatcccagttggtcatgatgaatgattttttaatgtgttgctgaattcagtttttaagtattttgttgaagattttgcatcagatttcatcaggaatatcgatttgtaggggttttttttggtttttattggggttttttttgttgtttttgatgtgtccagtattcccttctcttctattttttgtaatagtttaagtaagattggtattaggtcttctttacacgtttggtaaaattcagggttcaatctcgacaggttgtatgtatctaggaatttatccattactctaggttttccaatttattgccatgtagttgctcatagtagtctctaatgatgctttgaatttctgtggtatcagttatgatacctcctccttcatctctgattttacatatgttaatcttctctctttttttcttagtctggttaaagttttttctattttgtttacactttcataaaagcaacattctgttttgttgatatttgtgttgtttttctttcactttcatttattatcatcattattatgtctgctctaattttcttttcttcaaataattttgtgtttggtttgctcttgcttttctagttttctaagatgcatcttcagattgtgtatttgaaatttttctacttttttatgtagttacttattgttataacctttcctcattgcgttatttccactgtatctcaaaggtttgagtacattgtgtatccatttttatttgcttcaaaaaatttttaaatattcttcttaatttctttatttacccactaatcacttggaggcatattggtttatattccctgtgttcgttgtttgtacattttccagagtttctattgatttctgataccattccattgcagtcacagaagatgtttgatacaattttatttttttgatttttaaagacattttgtggctttgagaatgatccatgtgttgaggagaagaaggtgtattctgcagctcttggatcaaatgttgtgcaactatctattaggtatacttggcctacagtgcagattaagtcaaaagtttctttgttatatcttcttgctgaaatgacccccttatcattttataatgcccttctttgtctctttttgtagttttgtcttgaaatttcttttgtcagatacaagtatagctattccttctctttttttggttttcatttgtatgaaatatcttttaccatctctttattttcagtaaaatatttgtgtctttataggtgatgtgtgtttcttaacgtatcattgggtcttgtttctttattcattcagccaccctatgtattttgattgagagtttagtccattgctattattgttcaatgttattattgataaataatgacttactactgccattttattatttgttttcaggttgttttgtcatcctcccttccttcctgccttcctttttgtaaagctgattttccctagtggtatgttttaatttattgctttttattttttgtatatctgttgtaaattttttctttgaagttacaaggcttgcaaataacatctaacttagtattttaaactaataacaacttaacactgattgcaaaaaaaaaaaacaagcaaaaagaaaatcaataataaatctacaatttaacttcatctttccactttttaacttttttgtttctatttatatcttatactgtgtcttgaaacattgctatagttatttttgataggttcatcttttagtctttccactcaagatatgagtagtttacacatcataagtacagtattataatattctgtgtttggctgtgtacttgctactactagggagtcttgttccattcagatgatttcttgttgcacattagcatccttttctttcagattgaacaactccctttagcacttcttgtagaacaggtctgggatgaaggaaatccttcagcttttgtttgtccaaaaaagtcttcatttctccttcatgattgaaggatatttttgctggatatcctattctagaataaaagcattttttgtttgttttgttcgtttgtttgtttttccttcagcattttaaatatgtcacgccactctctcctggctggtaaggtttccattgagaagtttgctgcctgataattatttgagttcctttgtattttgtttcttttctcttgctgcttttaggatcctttctttatccatgacctcttggagtctgattaccaaatttcttgaggtagtcttatttgggttaaatttctttggtgttctataaccctcttgtactgaatattaacatctttctctagatttggaaagttctctttttttatccctttgagttaagtttctaccccaatgtctctctctgattcctctttaagatcaataactcctagatttgtccttttgagtctatttcccagatctttgaagagtgcctcattcttttttactcttttttttttggtctcctctgactatgtattttcaaataacccgttttcaagctcacttattctttatactgcttgatgaattctgatgttgggagatacacattcttcaatatgctgatcaaatttttcaactccagaattactgcttgatttttagaaattatttcaatctctttgttaggtttatctgataggattctgaattccttctccatgttatcttgaatttctttgagcttcctcaaaacagctattttgaattgtctgtttgaaagatctcatacctctgtcattccaggattggtcactggtgcgttatttactttgtttggtgaggtcatgttttcttggaaggtcttgatgcttgttgatgtttatcgatgtcttagcattgaagagttaggtaactttccagtcttcatagtctggacttctttgtacccatccttcttaggaatgttttccatgtattcagaggatattgagtgttatgatctaagtctttggtcacttcagctgtatctgccttaggagtagcccaagtccagcaattctgtgactctcactgactcagagatactgctttgctggtcttgggtaagatctgggagaattccctggattaccaggcagactctgattctctttccttactttcctccaaacaaacagagtctctatcttcatggtgagctacctggagctggggttggagtgatacaagtgcccccttggccaccaccactggtactgctctgggtcaaacctgaaggaacaacagcactaggtctcaccctaagcctgtggtgcctggctaccatcaatgttctctcaagtcccaaggactcttcattcagcaggtggtgaatccagccaggcatgtatccttctttgcaagctacttgcagctatgggcaggtccagaaatgccatctaggggtcagggcctggagtcaggaaccttaggaatctacttggtgctctattctatggcagcagattgggcacccaagccacaagtcaaagagcttcccattcttccttctcctttcctcaagccgaagcagtctctccctgtgacctgcactaccccaggcctatgaccaatactgcctgggttccactgatgtttactcaaggcccagggactgttcaatcagcttgtggtaagtgttgccaggactgcctaggtctcttccttcaggacaataggttccccgctggcccagtgcaggtccagaaatgacatagaaaagccaaggcctggaatcaggaaccccaggaggccatttggtgctatattccattgtggcttggctggtacctaagtttcaagatgaagtttcctttactcttccctctctttttgtcaagcagaaggaatctcttcctgagccaccacagctaggaaagtgctgggtcacacatgaagccagcacagcaagccttgtggcaaggattttctggctaccactgatgtttattcagctgtgggctctttagttagcaggtgatgaatactgccagaactttcctttccttcaagtcagtgggttcccttctggcccagcatgtgtctagaaatgtgatcatttctgggcaagcaggacttgcccagaaattgcagtccgtgtggcctagactgccctttaattttatttaggatcccagagcactttactctgtgatttactagctctgggctagccagaactctggctctgactactgggatagatgattcccctctgagtaggcctggtctaaatgctttctctatggtctaaatgctttctccattcagcagtccctggctgaattctgccccatgttgctttccactgtgacagggcagcactgagctccaatgcaatgtcccacaattacttttctctcccttccccaagcacacagattctttttccttgtcatgaggccactgccagggaatgcagcaggagtagtttaggcaatacaagactgtctttcctactctctttagtgcctctttctttaacatgatgttaaaaccagacactcatctaatcactcacctaatttttggttcttatgaaggtgttttcttgtgtggatagtgttcaaatttggtgttcctgcagggggaacaatcactgagggttctatttggctatcttgctctactctgctgtattagacaccttcagtacaacaataaggtcattgcaaagtcactggtccttgaagcatttactgaaagtttgacttgttaccataaaacagtaactactctttaccactaatcactagtattcaagactaaaaagcgtcttccttaagcagcaactacaggcatgtcgtccctagaatactgtgcctaagaccgctgtctcacatatcatatgggacagtaattgtaaagaatgtggttgtttttccatacctcaatgcagttttcataaagacattaacacattttaaaataatggtgtcatgagatattcataatgtacatgtttcctataaggtcatgtatatgatcttgaagtaattaaattattctaatttcatctctctcatttttcttttaatcttccttctttctttctctttccttatttaattcttcttccctttcatttctttcttattcattttctcccttccatcttttcctgcctttctctttcctttgttctccaagtcagaaatattattcttccccatttaatcaacccagaggctcagtgatattaaataattttcttcttatgccatatcatactgaaaagaaggagaaaagcgttttaaaatttaattttctatatggctatctaattttgtatatggctatctcaaatccactacttgttcagaaagatccctttgaaatatctaagtaagaaaaaaatgtccatttttcttgggctatacatcaaactgcagctatctttctatagccccattgttctctctcaaatgaagtctgtaataacctgatgattatattaatattttgaaacagcataatacagtcaaatggacagtatagtccttgccagcatatagtagtatggcattgaccccgtttcattttctgttgcttgacagctttgtgctcttacatggctatttatgataatcatgtggaaaattattgcaatgatgcatgtttagttgaggaactaccaaaattcctgtgtaatttaatccagtttggaggaaacctaaacccattctaaaaatcaacaagcagtaaatacttaaataggaagcatatatgtctcctctggaaatatgtttcgaataagcattatgaatacaaaacaattctaaaagttttggattccaacacaattactgttaataactgtttattttaaatatgttaataaagaatagtttttcctaatatgaaaaaagagtaaattatttatttttaattctttactattatagcaaagtgttcaatgtagtaaaacctgttggatttttctacaataaatatgggtactttgtcacctaaaaaaatcattggttattgctgttctttgaattttaatattcctgaaggttaaatgaaggctttttgtctgatatgacagatttttcccacagcagggcaaaattttgagaaagctggatgcatgattagacaccataatctttcccacacatcaggtacaaatagttaaattatcttcatgaatatgagattatgcatgcaaaataaacaaatttaaatgtgtatacaattacctgtaatctggaaatgaagtacatattgctcatgaactgtaattatttgctgtcacacatagagatttttgtgtggttactgatgtctcctattagaagcagtccgtgaattgccattactaaaactcaccagtttttatggtaaaatggcaaaagatctttttctgttcttaagaaattcaaagtttttaaatctattttctctcaccacaacctgcagagacttgattttatgggcaattaagataaattttactcaattatagaaattgtactaacttagaaagcataatatatttttcataattttctgtcattctttacctcttcaataataaaggcttacaaccaactactaatgggtttcttttaatgctaatatttcaattttttggctattctgagagaagtttctctagtgataatatcatttaaaatgtaatttttgcactcaaatatttattttattttcttgaacactatcaagtgttcatgagaagctcacagaatcttttgtttcatgggccataaataaaccccaatccaccacttcagcacatttctaattgtaatgcaccgtgtaatgttataggccattatacagatgttttcagttattgtaaggtggcagacagtgacattgaaatgtctgcttgctttaaagagattgtatgaactcaatcttgactcttaacataatagtttttttaaactatcaaaacccaaatgaattcaagcgtgtttgcccttcgagttagctgatatatttgaatttttcagcataacaacttggtgaaaggtatgaccttgcttgtcttaattagatacaaataaaaagataaggatatttctctgattcgtacttcactgtatatcttttccgaagaggttcaacaattgatatcaagcacaccgttcatatagaaagttcctaagttacagtctttgggcttatgattataaacaatgctactctctttttcaacgtaataaaactacaatctgaatttgttagtttttttttttttttttcagtttatggttgtagttctctttatgtggaatggatgaaccctaagtacggatgaaggtatattcatttaaacaacatggtgcacaattttgtttcaagactaacatttcccttggaaagggaagtttattagatctgaatttcttgcctacagatccaaatgttggatgtgaataatctactttttgtaggatagagaaagaatcagactcactttaaagccaaaatatactagctattaacttttagccaaaattaaaatgttccccaaaaaagaatatagacaacactaagaagtctaaggaggatctacgttgaatgttttcatctataacaataataatattgatgaaattcttatgatattagtaagtatcaggaattatgctgaatactttgtagataccacttcactgaatcctcaaaacaacatgaagaagtagcaactaacatttattcaacatttaactaggtattttattattgcacttaatcttcaaaatacattcaagatagtactattattctttatctaccaatgagaaaaactgaatagttgtataatttatcaaagatctttgcagtggttttctattgccacataacaaattactacaaacttagtcatttataacagtgcccatttgttagttctcagttctattgatcacagttctaaacacaacatggctgggttctctgttcagtgtctcgcaagactaaaattgaggtgtcatttagactgagtacttgcctcgaagttccgcggtagaatctgcttccacacttaccaggttcttggcaaaattcagttccctatgacagtagaatcccattgatttgctggatgtcagctgaggctgctctcagttcctagagggtactcacattctttggccatttggccccctgcatctttaaagtgaataatgaagaatcttctgtcaaattcctctcataattcaaacctctttcacaggaagactcttgtcccttttaagactcacttaattagaaggatattcttttcttaaggtcaacagtgtcatataacaacctaatcacaagaatactatcccatcacattcacagtcttggggactatacagactgtgtacaaaaatgggcaataatcttgaaagacatcttagaatttgcctatcaaggtcttacagtaaatggaaagcaggcatttttttttttttttaaatctctatggtcaaagctctaggcttagccatttatcagttctagtggggttagtataggaaggaacctctagattctccagagctatctcaaagtgagaaagagattgctttttcactctgggaagttctgctttttttttttttgagacagagtctcactctgttgccaggctggagtgcagtggcgtgatctcgtctcactgcaacctccgcctcccgggttcaagcaattctgcttcagcctccctagtagctgagactacaggcacacgccaccacactcagctaatttttgtatttttagtagagactgagtttcactatattggccaggatggtcttaatctcttgacctcctgatctgcccaactgggcctcccaaattgctgggattacaggtgtgagaagctctgcttttaattcaacttttacacgttgagtttatttataaaatttcatttcatttgaagaaaagttcagcagttaataattttgaaaaaaactgttgctcgatatactatttttaatactaatattacatgatttttagtaatggaactgtatgtatgcacaaaagtatagattaatttttgaggaataatttacatgtaatgcaaaactgtaagttttgacaaaagcataacacccaaaacctataaggtagaaagcattttcaatgctccaaaaattccctctaacccttttaagtcaattgtttctcccctacgcagaggcaacctgtgttatttataccactgtattttagttttttctatcctaaaacttcctatagataaaatcacacagtgtatattttattgtgtcttgcttcttctcgcttcttaatgtctttaagatttagtcatgttgttgcatacgtcagtagttcattcatttttaatatttagtaaaattccgttatatgatatgccacagtatgtttgtccattctcaagttgatggatatttaggttgtattatcagtttttggctcttataaatgaagggtgttatggcttggctctgtgtcgccactcaaatatcatgttgatttgaaatccctaatgttgggggacagacttggtgggaggtgattggatcatgggggcagacttcccccttcctgttctcataatagtgagtgagtttccatgagatctggtagtttaaagtgtgtagttcttctccctttgctctctctctttctcccactctgccatttgaagaaggtgcttgcttccccttcaccttcggccatgactataagtttcctgaggcctccccaaccatgctttctgtacagtctgtggaaccatgagtcaattaaatccccttttttcataaattacccagtctcgggtagttttttataacagtctgaaaatggactaatacagaaaatcggtaccagagaagtggggcattgctataaagatacccgaaaatgtggcagctactttggaactgggtaatggcagaaggtggaacagtttggaaggctcagaagaagacaggaagatgagggaaactttggaacttcctagaaatttgttgaattgttgtgaccaaaatgccgatagtgatatggttaatgaagcccaagctgaggtggtctcagatggagatgaggaacttactgggaattggagtgaaggtcactcttgctatgcttttagcaaagagactggtggctttgagccatgctctagagatctatgaaactttgaacttcagaggatgatttaagtttctggcagaataaatttctaagcaatgaagtattaaagatgtagcctggctgcttgtaaaagcctaaacttatttgcataaacaaagaaattacctgaaagtagagttatatttaaaagggaagcagatgataaacttttggaaaatgttcaggtagtccaagcagtagaaaagaaaaaccaatttcctggggagaaattcaaagctgcaaaaatttgcctaagaaaacagccaaatgttaatagccaagacaatgggcaaaatgcccccagggtatttcagagaccttcacggtagcccctcccatcacaggctcagagggctaagatggaaaatggttttgtgggcctcacccagggcccagctgccctgtgcagcctcaggacatggtaccccatgtcccagatgctctagctcaagccgtggctggaagggggcaaggtacagctcaggccatttctcagagggtacaagccctaagcgttggtggcttccatatggtgttggtcctgtgggtgcacagaagacaagagttgagatttgggagcctccacctagatttcagaggatgtataaaaatgcctggaggtccagacaggaatgtgctgcaggggagtagcctacacagaaaacctctactagagcagtacagaggagaaacgtggggttgaagtccccacacagagtccccacttgggactgcctagtggagctgtgagaagagggccaccttcctccagaccccagaattgcagatccactgatagcttgtaccatgtgcatggaaaaggtgcaggcacacaatgccagcccatgaaatcagccacatagtctgtactctgcagagccacaggagctgagctgcttaaggccttgcgtgcccatcccttgcattacagtggcctggatgtaagacatgaagtcaaaggagattatttccatgctttaagatataatgactgggtcgggtgcggtggcttatgtctgtaatcctagcactttgggaggctgaggcgggtgaatcacttgaggtcaggagttcaaaaccagcatggccaatatggtgaaaccccgcctctactaaaaatacaaaaaaataagacgggcatggtggcagacacctgtaatcccacctactcatgaggctgagacaggagaatcgcttgaacccaggaggcagaggttgcagtgagctgatatcatgccactgcactccagcctgggcaacagagtgaggctccatctcaaaaaacaacaactatatatatatatatacacacacacacatatgtatatataatgactgcctttctgtattttggacttcaatggagcctgtagcctgtagcccttttattttggtcaatttctcccttttggaataggaacgtttgcccaatgtctgtacctccattgtatcttggaaataactaacttgttttaattttacaggctcatagatgaaaggcacttgccttgtctctgatgagactttggacatgcatggacttttgagttaatgctggaatgagttaagactttgcgggactgttgggaaggcatggttggttgtgaaatgtgagaaggacatggaatttgggaggggtcggggtggaaggatagggtttggccctctgtccccactcaaatctcatgttgaattgtgatcccagtgttggaggagaggcctggtgggaagtgattaaatcacagagaaggactttccccttgctgttctcttgataatcagcgagttctcacaaaatatgcttgttggaaagagtgaagcacttccccttttgcactctctctctctcctgttaccatgtgaagaaggtgcttgcttcccctacactttctgccatgattgtaagtttcctgaggcctccctaaccatgcttcctgtacaatctgaagaactgtgagtcaattaaacctcttttcttcattaattactcattcttggttcgttctttatagcagtgggagaacagactaatacaaagtggctacgcatatttgtgcacaagtgtttttttgtggccctatgtttcattcctcttgggtaagtacctctgagtggaaattcatcttcttagcaattttggggaatttgtcttggcaattttattttggttttcttatatgggtacattgtgtggtgctgaagtttggacttctaatgctcctgtcacccaagtagtgaacaaaatgcccaatagatggcttttcaactgttgctcctgttccttttggcccactttagaaatctctagtgtttattgttttcatctttgtgtctgtgtgtacctatctggaagtaatatttcttagaaactcaaatgtagagagggttttataatatatgcagaagtaaaatatatctataggataaaagatagaaagggataaatggaaacctgttattctaatgttcttaccttatacatgaaaatatttagtattattaataattccaaatagattgttgtaaattgagcatgcatattttaatccttataacaaccactgacataaactaagagatgtaggttaaaagccaatagaggaaataaaatgaggtttaacctaaaataaagcaggaaaagatgaaaaaggaacacaggacagatgggaccaatagaaaacaaaataatgagagtacaattacacccaaccatatcaatatggcattaaatactaattgcttgtattttagcctaaagaactgtatataatttttattggaattaattttgctggtaaaaattctctcaaattttgtttgaattaaagtgttttcattttttttgaaagaaatttttcatttttgatggaaaattcaaggatgacagattctttctctcctttaggcacattgaatatgttattccatcatctgctggtttgcattgtttttaataacaagccagctgcattttatcagttcccctctatataaagttctttttgtactttttaagatattttatccttgctttttagcatttttccaagatgtacctgtgtatgtgtgtgtctgtgtgtatgtgtgtgtgtatgcacacttattttgcctggagtctgtttagcttcataggtctgaatattattaattttcatcacattttaacatttttagtcattattttaaaaatatttttctacctcagtctattctcattctagaaccctaatgacacgtatatcagactacaattttatattgtctaacatgttactaagcttctgttgatttgaattgttttatcactttacctcaatttggcaaatttccgttgccctgtgtcatattcaacattcatttcttctaagtgctctatttgctatatgtccattctatgattttttttcttcaggtactttgttaagaattggaatattaccttagttctttttttatagttttctttttctgctgagaatccctcatccattcactcattttgactgtcattttctttaaatccctgaacatatttataatcactattttaaagtctctgtcttctattcccaacatctgtgtcatctgtttatcagctgttttatttcctgcttatacttcatatttcttgtttctccatgttgagtaatttttaattatatactgaacattttagatactatcttgttgaattgtggaaattatctttttttaaaagagtgtaagttcttttaaagagtttttcttccatattagatttaaagagtatacattcttttaaatagttgttttactggcatatcaggcttcccttttcaattttgtttttaagctttgttgtggctggtgtagaatagcggttacttttagactaacgtagaccttattttaatgcatggtctttctgggatattacatttgcagtgtgcagcaaggttcttctctctggttggttaaaacttcaacatttcctagcagaggataacctgtagagtctctttcaactcaaatctgccagtagcttttcttggcctcgtggattctcactttaagcatgcctagcttactttttagccaaatactcaagggtactttcataaagattgtggagcgttcatggcacagcttctcccaacctagtaccctaacccataaatttatgcactttctgcagccctaaatccagtctttatatcctacaccaagcaaaactgaagctttgtgttttggcttcacttcagtgccataatatggaaaaatcccccaggcagaaagataccataaatatagaactcacatcatgtacatccctcttttctcaaggattactcttctactgcgtgtatgtagtgcctaaaattaactgcttaatatatattgtcaagttttatagttattttagagaagagagtaagttcaatttctataacttcatcacagccaaaataaaatttatttctatactgttttctatgctatttccaatttaatctcattaggagacttgagtgaccaaaacaatctgtctgtattggttaagcacataaaccttggaaacagcatttctaagctcaaatcttgtgtggccatttctgagttgtaatacttgggcaagttacctagccttcctgggcctcagttttctcatttgtaaaatgaacatcatgatacttccgaactcaaaaagttttagtgaaagttaaatacattaatatattatggggatatcagcaagatgactgactagagatgcctggtgttcatccaccaccccccaaactcaaaaaagaagggccaaggcaatgaataaatagttaagatttgactggtgctttgaagggagagcactagaatggagcaagagagtggagatgcacctgtggctattggaagttcaggagaggcactaagcctctgtagcccctgctcagatcagatctacctagagtctggagggacttctcattgctgggaaaaggtaagcagaagatctccactagaccccattgtcactgcaaatacctacggtcattataacagaaaaatcacatagtcatagcaagtcataatctgagtaaagagcttccaggaactcatggaactgcattgccccagattaggagcacaaagtgtgtactccccacactccatccacgccatgtaagtgaagctgctgcagcaaagtgccatcttgagggcagagatctctggagtgcaccttgctctggaatccagtagccactgcaactctccagcactggagcttcatattccaccaagcccactcaggtggctaaactccacatccccagaggcacaaagccttggcccaggatcagatgtgactctgatcctgtattgcagggaaaccaaccctcaccactgcacttctagctgaagaaataatctggcagtcccaccatggatgaacctgcttttaagctggccaaattgctgaccactgttcctcaagcaggagaggcccctgagcctccaagcaactgataggcccccattgactacatatctatgatcaagacctgagaaatagccccacagcaaccctgctccgcaacccacagacaagcccttggcctgtctatataaaagatatatagaacaaccagaaaaaagtaaataaaacggcaaaagtatgttctcatatatcaataataacattgaatataaatggattaaattccacatttaatatagtagattgactaaatggattaaaaaaaaaaaaaaaaaaaaaaaaaaacaagcatgacccaactatatgctgcctacaaggaactcacctcacctgtaaatacatacacagactgaaagtgaagggagggaaaaagatattttacgcaaacagaaaccaaaagtgagcaggagtagcatacttatatcaagcatagcaaacttcaagtcaaaagctgtaaaaagacataaagaaggacattgtataataacaatgggattgattcagcaagagagtataatcattgtgagtatacatgtaaccaacacaggaacacccagatatataaagcaaatattattagaactaaaggaagaggtagacaccaatacaataatagttgaggactgcagtacctcgctgtcagcactggagagatcatcgggacaaaaaatcagcaaaaaagcattggattaaaactgcaccatacaccaaatagtcttaacagacatttatagaacacttcacccaacaaccttaaaaaacattcttttcatcagcatacagaacattttccagggttaaatatatgttaggacacaaaacaaatgtgaaaatatttttaaacattgaaatcatatcaaatatattatctggccacaagtagactacaatctgaccaaaagtagacattaatcacaagagaaatacttgaccctatacaaatatatggaaattaggcaacatgctcctgagttatcaatgagtaaaagaagaaattagaataaaatttaaaatttattgaaacaaatgaaaatacaaacaaaatccatggggcacagcattaacaggtgggtttatagcaataaatgttcacatcagaaaactaaaacgttttcaaataaccttatgatgcatctcaaggaactagaaaagcaaaagcaaactaaacctaaatttaggagaaggaaagaaacaataaagtttagaagagaaataaaaagacaaaaaaatgtaaaaggtcaacaaaacataactttctttttgaaaagataaacaacagtgacaaatcgttagctagactaacaaagaaatatccaagaccagatggcttctaccatctgaattctaccaaacatttaaaggagaattaaaaccaattctttttgtactatttcaaaaaaatgaaagcaaaattttcagattagcaaatagtatttgtacatattaatcaggtacatagtgatgtttcaattcatatggtatatggctaagggtaactagaatattcatcatctcaaacatttattatttctttgtgttgaaaacaatcaataccttccctctagctacttgaaactatataatatattgttgttaactacagtgatccgacagtgatatagaacactagaccttattcctcctatctagctgtgcacattgacaacactacctaaagcaatctacaaattcaatgcaatccttattaaaataccaattatattctccacagaagtaggaaaaaaaatcctaaaaactgtatgacaccacaaaagaccctgaatagtcaaagcaatcctgagtgaaaagaacaaagctggaagtatcacactacaagacgtcaaaatataatacaaaactgtactaaccaaaactggataatagtggcataaaagcagacacatagaccaatggaaaagaacagacaacccagatattaatctacatctctacagccaaatgatttttgacaatggtgccaagatcactcattgtttaaacgaccatctatctcttcaacacatggtgctagaaaaaaactagatgcccacctcttaccctatgcaaagatcaactcaaaatggattacagacataaatgtaagacccaaaatgataaaaactattagaggaaattatatgggaagtgcttcaggacagtggttggagaaaagttttatgaataagacctcaaaagcataggcaagaagaacaaaaataaacaaatgagattatatcaaactaaaaagcttctacacggcaaaggaaacaaccaaaagactaaacagacaacccacagaatggaagaaaatatctgcaaactactcatctgacaaaatattaatgttcagaatatacaaggaactcaaacatctcaacagcaaaaaataaaagtcttattttttaaatgggaaactgatctgaatagacatttatcaaaagaagacatgcaaatggccaataaatatatgaagaaatgctcagcatcacttaatcatcaaggaaaggcagatcaaaaaccactaggaggtatcaactctccccagttagaatggctatcatcaaaaagacagaaaaggtaacaaatgctggtgagaatgtggtaaaggggaactcttacgttggtgtgaatgtaaaccagtgtggagaacagtattggcgtgcctcaaaaagactacaaatagaactaccaaatgatccagcaatcctactactaggcatttgtccacacacaaaaaaagggaaataatattgaagctacatttatatccacatatttattacagctgtatccacaatagccaagatatggaatcaacctaggtgtccaacaacagatgaatggataaagcgaatatggagtactattcagccataaaaagaatgaaatcctgttattttcagcaacatggatggaaccagaggacatatgttatgtgatttaaatcagaaaaagaaagttaaacactgcatattctcaatcattttgatttcacagaagtaaaaagtagacagaggataccaaagactgggaagagaaggggaaagggagggataaggggacttttgttaaaggatacaaaagtacagcaagataagaggaataaggtcttgtgttctataccactgttggataactgtatttaacaacactatattatacagtttcaagtagctagagggaagatattgaacgttttcaacacaaataaatgataaatgtatgagatgatgaatattctagttaccttagctatataccatatgaattgaaacctcactatgtaccctattaatatgtacaaatattatttgctaatttgaaaaatttgtttaattcagaaaaaaaaactttgcagaatatgagccatcacagctcattaccttaattctgttagagaaaagccttccctcatggtactaaagttgttagctactttgatgtgtagcaatagttgtgagttttattttcaggtttaactactatgtggggtattttaaacatatatgtgaacttggacttttccttgaagggactaagtataattaaatggtctgcccatacaaatttgttcaagccttgcaacacaggttcatgaaaatctaagaactctaaattatatttttgacaactcagaagaaaaacacaaacacaaatgaaatgtaagaactttattttaaaagttgattcctttaaagttcatatggaatcaacttttaaaataaagttcttacatttcatttgtgtttgtgtttttcttctgagttgtcaaaaatataatttacaattcttagattttcatgaacctgtgttgcaaagcttgaacaaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgactcagccatcccattgctgggtatatacccaaaggactataaatcatgctgctataaagacacatgcacacatatgtttattgtggcattattcacaatagcaaagacttggaaccaacccaaatgtccaacaatgatagactggattaagaaaatgtggcacatgtacaccatggaatactatgcagccataaaaaatgatgagttcatgtcctttgtagggacatggatgaaattggaaatcatcattctcagtaaactatcacaagaacaaaaaaccaaacaccgcatattctcactcctaggtgggaactgaacaatgagatcacatggacacaggaaggggaatatcacactctggggactgttgtggggtggggggaggggggagagatagcattgggagatatacctaatgctaggtgatgagttagtgggtgcagcgcaccagcatgacacatgtatacatatgtaactaacctgcacaatgtgcacatgtaccctaaaacttaaagtataataataaaaataaataaataaataaaaaagttgataaaactcaaatacaacattttaactgtaatttagaaagataccttgggacatttcaacagcacaagtgataaattacagactcctgatgtggatactttggtcatatttaaatttattttgttaaagcattgagataaaattgagattaaaaattaatggaatatgaaaccaaagggttaaagatgagtaataaaatcaagagaaattattctgggcattgagaaataaatagtaaaaatgaaatatttcaattataacaaaaatggaattcattgagaagagactaatcatttcacaatgtatatatatataaaaacatcatcttgtacaccttaaatatatgtaattttgtcaattatatctcaataaagctgaaaacaataaaattgcaaatgaaaggaatttatgagcttttaagttatttaataattggtagaatgagttatataagctcatcgaaatatattcaaatttctttctcatttgatctcaaactgttttgacaaagatgacataaaactcaatacataattacaatgagtagattggtaactgagtgccttcaattcaaagactatgtaagattagtaattgtataagaaaacttggaatgtgatgaaatgcctatgtaaaaaatatttgagagagctttctgaaatttgacaaaaatagtatgtatatacacacatacacatacacacacagatataaatatatatacacacacatacatgtatattggttatatacttttatatagccaattatatatagccacagtttaaactgtgaaaaagtataaaataaattttctaaactatcactaataaaaagtaaatactgatgaatcaaactatagaaaacactaaattatctttctatctctctttagaaaatattacaaactattcttatatgaagagaccattaaggagtacacagccataaattgtaagaaaaaaagtatgaagcggtgtgcctggcagttaattaataaaatatatataattgaagaacccaaatgttataattacttattactacccaataatcttctacagaccaaacaaaaatcataaacacaggcaaattgttactaccacgagtctgttacatatatgattatgtacctatattctgttttccagggagaatttcttccaacagaaagaaaaattaagtaaattggcataaaggctagcaacaaattagccagtagtttgttgcttgctatttctttgctcctggtcttctccaaatgggtaagcaagtatactccatatatttatggttaaggtaggaggaagataccaaccattttactaagtattagctcaaaagtcttctatagaacaaataaatgctgacatttaatgaaaattctgatcagtgccaaagcaatacagagtttgtacctttgtctgagaattaggtgtttgtttatctcatctattgccttatatcacaagttgccctggtggctaagcctttagaaaaaaaatgctatgtagatgattcttcaatttttaattctactcctgactgagtttaatttcttatcgtgtagttgattccttatttaagtcctcctctcacaccaggacaacatacctccccatggaaaattggaatacaagtctttatcccttctgggttattacaaacttttgcacctcaactttcaggcggttgccactagagtcttcactactctggctccccctgccccttaaaaagggaaagaattagttctattccttttggaaatggggaaatagatgtttttgttcattcaccagtactatggccaggctacctcttacctgatgactattacaacttcacataataaatgtgagattatttttttctccaaagatcatccactccattgtacttgagacaaatggaagaaataatcttctacattttaacatgactcttacatgctatttataaaataactctattatgctgaacatatccatcttctggcccagtatcaacccaaataaattgagagtacctctgcttaaaacttgcagatacgaagaacgatccttacattgtttctcaatgcaagcctttgatttctcacccaacagcaagcacaggtgttttactttaactagcttcaagtctctcctctccaacatcaactacacccttgtaggtcaaactttatcttctgcctttccttctcttttggcttcctcccatcaatacttaaatatgtttaagtctctctcatctaagaaaaaaacccgctaaaatgtcattgatccatatgaaactccaaccatgtgttgtatcttttctgtcttttatagcacagcctttcaaagttttctttgtagtctgcagtcactttacaggcactcatcaattcatcaatctctggttgttgaatctgttacataatataagtcatttttaccagggtaatagtgagtaaacccactgttcctttctcagtcttttatgcagcatttggtactgtctaaatgctctcttcctctaggtctctgagtctgtgtcctcttgattgacatcttacctttggctgtaattgtgtttccttcactggcacttgtactccctctaattaaatactagtgtttcctgaagtttgatcctaagctatttccatagacaacaatattttatctcagaaattcaattgccatctccatagtgctctcatttttttttccttgttccataagtttcttcagtttcagactagaaatgcttactccgtctcaaaaaaaaaaaaaaaaaaaaaaagaaatgcttaccaaacgtttacccttataagtttacagccacctcaagcttaccaaatctcaaactaaactcataattcattcatggctgtatcttctcatgtcctctgtctcagtgagtatcaccattgtcttcccatttacctacatcagaaccccaggcataatacagagctcatttatctccttctttatatttaatcaatgactaaaacctgtcaattcttcatccaagatatcttacaaatctgttcattgttcttaatattcatcattattactttacaggtattgtcatcttctaactagaaaatactagtataaatactaattccttttcttgcctcatttggcccttatggtatataatgctgccccaaagatcttccataagtgcaagcttgtatctgctacccaccagccgaaaacctttccacagccccttcttgtggtaaggaaaagtccaaacacttcatcctacttacaaggcttacatgaccacatccctgcttattgctgcaggcttatttcttatatatatctcttcgacttatcttctgagcatcagctatacagaacttatttcaattcgccaagcatgtcctatacctgcttgcttccaagccttgccatgtggtgctccctctttctagaaaacccctcccactatttatcccttttcatccccatggagacttggtatcacttcttgcatgttaatttcttatggatatgtatgtacttctctaagtgatttgggatctatcccaagcactttcattttatcctataatctccctgtaaagttacatatattatttccctctactataaataataaacaacatgaatacagtacttatacattccttgttcaccattgtgtcccacatgctaggcacagtgcatggtatataaatattatgtttatataatatatgaatgaatgaatatatgcattaaaaatgacttagcaaaacatttttaaaacttccatgttcttcaccatgcctttctttctggctttaccacctccacatagcccaatatggtacattacacatgcaattagggtttccaaatggattatgttttctgccacctctgtgtctttgcacactcgccctctctggagtgctcccatatggcttcttcacatggactactcagctgaaacttcaactcttctaaaaaccagtttttccaaaaattcactgacatgtcatccgcttgactcctaacacctgttaggccatttctctgttaaatcacctttcactactactacacaaataagattcttcttttcaaagctagtgatgatattttggtgtaactttttatcaaatatctagcagagaaactaacaaataagaaccaatcactgtttactgaataaaagagggaagaggcaatcctaatgactcatgatgttttagtggcctgatgggttaaaaaattttaggtatgacgttatatatctgaacgtcaattctcaggagtaattaaataaaataaaaattacatacacattagcttcctttacatttcatgttcactaacggtaaattttgttgaaccatttcttcatagtcaacaaaaaggaactatttatattttagagttgagcagtaaatcagaacctctaagaaatcttacctgatttgagtaaaccaaattagccttactacctttataccatgaagagaatttctgctgccaactatatttacattagatgaaatgaaaggtgaaggcttcatttattcaactactcacctgttcctcagcaagaacttaatatcagcccaattttttggaaaaacttattttgatttaattttaaggtatttcaatatttccagttttcaaataacattttaacaatatttgatgccctaaaaactaaaagaaaatgtatacaataacatacacatgaaataagatattctctagatttctctgaatctcaaaactaattaatgaagattttacaactcagaaaataattattacttgagttcttaaaaaatagaagaaaaacgaagttgcaacaacatttttttttcttacatacaaggacaattgttattcattgctttcttgaagcagttgatgcatctttggcatgattaatttttcttaacagctatatcatgttttgaatttactacataaccaagttttaagcttataatgttccaaagttgaaaagagaacataacttatgaagtgcttgtaatacctatatgtatgtttgaaaatcattaagtagttgttactctctcttccccagcatcaattactccactctaaatttacttactccactcaatataatgagctcccagagcacgtttcatttcaggggaaagtacacattcttcacttgtggtcagtgggatgtggttaatttgaaatcacttaaactattatatctgtcaagtgcagttattttattttcaattcacatcagtgttttagtatgcatgtcagttactaggtcaaactgacagattaattcaggagcattttgttgcaatgctcttcatcactgtcattgtatgtaggccactaccgaaaattaatacctgcccattaaaattgattgccaaagatatcacctttaatgtaaacaataatgtatagataagaaaatggtgctaaattagctattatggttcacagctcctatagtatgggccattcagttatggaaaatatttcaggaatattaaactttgaaagcaacaagatactgaaaaaagcttttggaatgctgtaatagtcctggaaatagtctggtgaggcttttagtattattttagtctgttgctccttattatagctaggatttcaaatgtgtgtgtgtttgtgtgtgtgtgtgtgtgtgtgtgtgcagggagagagagacagagagagagacagagagagagacacagagagagagagagttgatttactttaaggcataatatttaaaggtgaatattgcattggaaaaaaggtctatgttaaacttgtaaaaaaaaatagagacactgagaaactggctgggtctatctcaataataaatagccatgaattaataaaaagtaatagaatttaaatgagcatttggaaaatatactgccacaatagcatacatgctgcattagtaaactgtatttttgccacatgtagccatgctttcatcattttataatactgccaacaatactgagcatttgatagtgaacaggtctacagttttcttgggagttgtataaataaggtgaagctttgattaatattatatagtagcaaagatataaaattcaaaacaacaaccataaaaacttatcaaacactaaaaaaattcatttcctcataaaagaagaactatatactctggaaatagtgctttgaagttacaccacttttattaaagtggtagtacaacaggaaatacagcataacctttattcacaggcacccagagctgaaaccttcaaacatctatgcaaaactggaaactacacaaaaaataactaggcacagcccaagaagacccagaaatgtagtatagaagcaacccccatgaaaccttttggccatggcagaaacaccaaaagatgttactttgaaagactatgcaacactgcatcaagaatgagagcgcaatgaagtattcctggtagaaattagtgaaatctttcttatctgggaagtgtggatcagcactctccatatcgctttcctgataattcagaaatattctgcttctgacctgcaagctttgattccttacaatatgtgtatcttttcagtacgctaatccagtcagtaaatcatcagctacagtgcaacaaaagtgtagttttaaattaaaccaattaacaaaaaaccttgactcttctcattaaattctgaaattcttgtgttctacctgtgtgttctttgaagaatgtgtttttaatattctgaattaatccgtgtagcgaaatattgagaagagcaaatctaactttgtttttaaaatatatttctagttcatttgacattgctgattaagttctagtggctagttcaaaagtatacacttatggaacagaaaagggttgaaaaataaacatcattcaaactatcttaatcctatagtaaataactgagtttatagactaaaagcagttaactaaaaaatccttaatttttgaagtcgacacagttatacttgagagccccaacataaatttctattcacatttgtttctttggaaaataatttagtaggatgataattggtacactgttactaaagggtttgagaagcacagaattaaaactgttaaactgcttttttgtgtttggtatggattttactgtgctattatgcacatattatgcatatgcatatgtgctaacataatacgacttttttgtaatctcagaaaatcatactttggggcaatatacaaaacatttatctctagtaatgttagtaaatatgagggttaacccaagttaatttacggagttacctctaacccaaaggttctcaatgttattcatgagaatcttctgtgaggctttattaaaaatgcctgcaatacatccagatctattgaagaggagcaatggggtaaggtctttaattgtataattttagtaagttcgataaaggattctcaagttaactcttgtttaagaaacactgctctgaatattgttgttactttctctccaagattcatctccatttatatctctatagctacctaatcatattgtttacatgttgtagctctagtcttcccttacaagccagattaagatggcaatattcaagacagtcttgaataaaagcacctactaacagaaaatttgtaaaattagatgctctaacagagtttatatcaatccccaaaacttgaagctataataagggcattaaatacataataataacatgaagataaaatataattctctaacaaatcaagctacctttctctttcaaaatccaacttaagactttcagttttcagttctgcatgtaagtatcctggaagttgccactcctttctaacaactagtgaaaagctgaacagactgaaaaaaccaagaactcttcttgaattcataaaagaggtaaggacacagggcaaacttctacacctaaaattgggagaaagacaggtgactacagggagtcacagcttaccagaacagaaactcatgagtggaaatcacttcaggagccagttctggattaggaaaacttgaactgtaattgatgagttgctggaggcttggtgtggagagtatgagaattaaaaactccatgaaaactcagttattgtgggggtccctgcacatttgtgagttttacctacagaagtcaaccaggttctcaaagtaaatagagaaaaattcccttgtgctttcagcaggagaggggcaaaggaactattttgaaatatgccagagcacccaacttcttaacaaggcctgccctcaggagaatgtatttaaccagggcctaatctcctggtggttttatcagagcctaacagactcagaggaagggagaatacccaactccagccagttttagacatcctgtctcacctaagggaggtgggagagactagaaaatacttgtgaatttcacagtccagcagctatgattaggtctcaataaaagactgaaactcagtcataggtccagcaagtactttccctcccccgccaaacaccttaccaccatattactaaaggtctatttatagcagttctttttgcctggtatatcatgtacagctaccaagaaaaaattacaaggcatactaagaaacaaaaaacacaatttgaagagatagaaccagtcctggcagggatgctgaaatgatcaaatcagtatttaaaacaactatggttaatacgttaagaggtttaatacatagcacagacagcatgcaagaacagatgggcaatataagcagagaaatgaaaattctaagaaagaaccaaaaacaaatgctacaggtcaaaaacactaatggaaatgaagaatgcctttgatgggctcattatttgtgtgaacgtggttgaggaaagaatctctgagcttgaggatatatcagtagaaacctccaaactgaaaaacaaggagaacaaagtcggggaataaaatagaaaaaaaaatccaaagactatgagaaaactacaaaaggtgcaacatatgaataatgagaatatcagaaggaggaaaaaaaagagcaaggaatagaagaaatatttaaaatgataatgacagaatttcttcccaagtaatgtcagattatagctcttgaaggctcaaagaatgtcaagcaaggtagatgcaaaaaccacgaaacgaaacaaaaacctacacccaagcatatcatttttaaactacagacagaaaataaaaaaaaaatcttgaaagaagccagaggataaaagaccttacctatggaaggatgaagatgagaatcatacctgacttctcctcagaaactatgcaggcaagaagacaatggaatgaaatagttaaagtgttgacacagacaaaaacatcaatctagaatgctgtactgtgaaattatccttcaaaggcaaaagataaataaagacctctcacatgaacaaggtttgaggaaatttgttgctagtagacccgtcttagaagaaatgttaaaacaagttctttagagacaaggaaaatgagacagatcagaaactaagatttacaaaaagaaaggaacactaaagaagggataaatgaaagtaaagtgaaaacttttatttttcttattcttaattgatctaacagatagtttctttaaaattataacagcagcaatgtatttgatatgcacacatttatatcttctctgtgtatatatatttacatatgtttatatataataaaataaatgacagaaattgtaagaggaatacatggggaaattaggattattttgttattatatagtactcacacaacctgtgaagttatatggtgttatctgaaagtgaccttagattagttgtaaatgtatattgcaaaatctagggaagccatttttttaatttataaaagaagtataactgatatgctaagaaaggagagaaaatagaatatgaaatgctcacttaaaaccaacaaagagctcatactcgtaatcccaacatttgggagactgaggcaagaggattgcttgaggccttgagtttgaaaccagcctgagcaacataatgagacccccatctctacaaaaaaaaaaaaaaaaatagcttggcatggtcatatgcacctgtagtcccagctacttgatggcttaggtggaaagattgcttgagcctgggaggttgaggccatagtgagccatgatcacaccactgcacgccagcctgggcaagagagaccctgtctgaaaacacacacacacacacacacacacacacacacaatagaagaagagtggaaggcaaaaataggaacaaagaacaagagcaaccaatagaaaacagtaacaaatgtgatagatattagtccaaccatatcaataatcactttgaacatcaacagtctaaatgcaccaattaaaaaacagatactgtaaagtgaatgaaaagcaagacccaactatatattgcctataaaataaacccactttaagtatacagacatatttagtttaaaagcaaatatattaagaaaaatataccatactaatactaatcaaaagaaagtagaattactatattaatttcaaacagagcagacttcacagcaagacaaattatcagagataaagaaaggcattacataataataaagaagtcagtctccaagaacacataacaatacttaacatgtaacaacagaccatcaaactatttgagagaaaaactgatagaactgtatgggaaagataaatccactattacagttaaagatttcaacactcttttatcagaaatggacagatacagcaggcagaaaattaaaaagggtatagttgaactcaacaacaccatcaatcaactagatattattgacattaataaactactcaatagcaacagaatacacattttcctcaagctcacatggaatgttcatcaagacagactatattttgggcagtaaaacacattgtaacatatttaaaaggttagaaataacacaatgtcttgtctcagaccacaatagaattacattagaaatcaataagagaaggataactggaaagtttcaaaagttgtagagactaagtaacacacttctaagtaacacatgaatcaaatgagaaatttcaaaaataatttttaaatattttgaactaaatgaaaatgaaaaaatttatcaactttttgggatggagcaatatcagagctaagagagaaaattatagcactgaatgaatatattagaaaaaaaacaaagatctaaacatcaataatctaaatttaaaccttaggaaactagagagaaaaagagtaaattaaaatcataataggcagaaggaaaaaaagaattagaccagaaatcaatacatttgaaatcagaaaatcagtggagaaaaattaacaaaaccaaaagctcattatttgaaaagaacaatataattaattaaactttagccagcctagctaaaaacaaagagagagaacacaattattaaaatcagtaatgaaagaggggcaacattatagatcccatggacgctaaacagatcatcaagaaatactatgaataagtctatgtctacaaatttgataacctagatgaaatagatcaattcttgaaagatacaatctgcccaaaactctgatatagccaatctgaataaaattatatctattaaataatttgaatcaataattaataaagtttcaaaacagaaagcaccaggcctagatgggttcacttgtaaattctaccaaacatttaaggaagaaatttaccaattcttggtagtctctttcagaagataagagtagagggaaggctgggtgctgtggctcaagcctgtaatctcagcactttgggaggctgaggagggcagatcatttgtcatcaggagtttgagaccagcctggccaacatggtgaaaccccatctttactaaaaatataaaaaattagctgggcggggtggctcacacctgtgggaggggagtgatgggtggaagttgcagtgagctaagattgtgccactgcactctgacttgggcaacagagcaagaatctgtttcgagagaaagagagagagagagagagggaattctttctaactttctcattctatagggctagcattaccttaataccaaaaaaaaaagaagtcaaagatattataagaaaagaaaatcacggaccaacatctctcaggaacaaagatgcaaaaatccccaacaaaatattagcaaatcaaatccaacaatgtgttaagggaattatgcactataacaaagagggatttataccagttatgcaaggctggtctaacatttgaaatcaatgaatgtaatccatcacatcaacagattaaagaagaaaaattgcataattgtataaatagatacagaagatgcatttgacaaatccaacatccattcatgaattaaaaaaaaactcttaataaactatttctaatttaaattattattttaaaaatatgtttattttaactttcctgaaaaaatacatttttgttttcattccttttaagctgtgaccattcacaaagtcaacagaacagtctactctagtttatcaggttatttatagttgaagactgcagactacattaatggcaactatactttgaaaaagacaattattttcactggtagcagaaaaatctattttgactataccttttgtcagctggttaatcatattttaagagttatcttaaaatataatctccccaaaattaagctaaacatttaatagccaaactttcaataacaaataaatgtaccaattcattgataataagtatttgcttgtggtacatggaggatgctcaaataggtgttgtaatttcatggtcatgagacttaagcaaacaatatacaaaaatattacgtgtatttgctttaaaaatgaaacctaactatcaaagtacttaaatcgtaaaatgatacatttctgtggcttcttttctctctgacacttggcatgtaaacttgttgtttcttccaaaatatttgattaaagcaaaaacatcatttacttaattagaacgagtcatgtcaatactgcctttaaaaaatgctagaatattgttcttgtgaataccgaatcaaaatagaacaaaatgcaaaacttccagaaagttaatatcaaagtaatgaccttcataatattaattatgacatattttacgtgttctattaaatttctgttatcttaaaatattaaaaactgccttagtctgatttccagaatctatatggaacttaaatcaaaaagcaaaaaacaaatcaccccatttaaaaatagataaaggacatgaacagaaacctctcaaaagaagacataaaagtagccaacaaacatgtttttaaaaatactcagcttcactaagcatcagaggaatgcaaattaaaaccacaacgaaataccatctcacaccagtcagaatggttattattaaaaagtcaaaaaataacagaggctggttagactccagagaaaagggaatacttatacactgttggtgggaatgtaaattagttcagccactatagaaacagtttggaaatttctcagagaatttaaaacagacctaccatttgacccagaaatgctatcattggatatatattcaaagaaaaataaattattgtaccaaaaaagacacatgcaaccatatgttcgtcgccacactattcactatagcaaagacatggaatcaatctatgtacccatcaatagtgggttgcataaagaaaacatggtacatatacactgtggaatactatacagccataaagaatgaaattgtatttttttgcagcaacatggatggagctggaggtcataatactaagtgaattaatgaagaaacagaaaaccaaatactacatgttttcacttatatgtgggagctaaacattgaacacacatggacataaacctgggaacaatagacattgtgggctactagaggagggaggaaaggagtagggcatgggttgaaaaactacctattgggtactatgttcactacctgggtgcaatatgcccatgtaacaaaactgcacatgtatctccttatcgaaaacaaaagtttaaaaaaatgcctttgggaaaagccttcaagaccagtttacaaatcatttgagaaaagcagctttattaagataacagtagccacttttaatggttattgtatattatggaaattggcaataaatgtagctatgttggtaaaataaactttaagttgaaaaatattagaggtaagacctaaaaagaagggataatatgaacttatctaaggctaagtacccttactgactgatttgtttgggaattttttaaatacataaatatctttttagctgaattttttcattgaattttagttttataatatatattttaaactcaagagtaactgcacttttacccatctctaatacaatatttcctttctctaagaagcagaacaatttcagaataataactttcagtgaaatcaatcagctgataaaaatggcaggttcacacctctggtaggagtacagtgttgatgaagacaagttcacaggtttgatccctaagtgggccaatttactttgctacaggcagtccctcagacccaggactgacatcctgaaaatgggagccatcagtcataaggaaaaagtataggtgaagtagacctaacttatccccactgtgggagaacaactccaaatacaaaccagctaaaggttatgccatggcatttttcttgtaaataaaagagggaacttggctgggcttggtggttaagactgtaatcccaacactttgggaggctgaggcaggaggattgcttgagtctgggaggtcaaggctgcagtgaatcctgattgtgtcactgcactccagcctgggcaacagagcaagactctctcaaaaaaaaaaaaaaaaaaaagagggaactttcttccaaatgtagtcattggccctggtcagaatgtaaatctgatctccagaaacgtactttaagatcaagtatgtcaacaattactgaactagtaatgaattattagatagatgtggggagacaccaaaatagtgtatgaatttatttataatatattctttaccaacttcccataaagattggctgctgctcaaaaagaaaatacagctactagctaagaaattatggtaatagattggatagaataaaaatcatcaaagcattctgtgtcaaagtttcatttcactcattaatgtgggaactagcaagatgacaaagtagttccaaacagtatttgaaaaacagaaacttttagtcagtaggaaaaaagaaaaacctgaaataaagtgccaaattagacacaaagttggtaaaattacaggaaaacaaaaccatcacgccttaccagttttacagaagtataaaaaatgcccttaatctgtactgtaaacaaagccatattctgttagagaatattagaaacatctgggaagctttttaagctgccaataagtatgtcttacctctgatattctcatttagttggaaacaggtgaggtctgagtagaaggagttttaaaacctctccaggtgattttaagatgcaagcaagtttgagaaccactgcgttagaaagagacatggacttttacatgggttttcaaaaatttgccctagcatcttgttactcaaaatgtggcttatgattcaggagcattgataccacctgagactatttaaaattgagtatctgggggccccaccccagatgcactgaatcagaatctacaatctgaaaatatttccaggtgattcaggagcacattaaacttcgagaggcacttctgtaacatgatattgaaatgactgtaatcatctttttgcctcatttccaagttttaggaaacttttcctgggataacaccaacatgaaactgccaccatactgaaacactcaaaattttaaaaattggtaaatatcactaaaaagacctcaggtagcactttaaagataagaatgtctgtggtaaagggagtcagctgtaagctggaaagtctgaactaaatcagtcaatggtcccacttccaaggattctcaggtaccagttgaacctgggacaatcggactagaaatatttaagataaatacatagttgcttaaggaagcctaaagttaagatcatgttttatgtagccatcaatcacctttactaagagctgctgggaacttggggctggcagattccacatgtgtccattgtttgaatgcctaattagggaaaggtacaaaaatttcaatgaaagtgttttaagccacttacccagcgtctaattgttaaaattttgatggtccacgtgtaaatgcagacttagttttaactccgttctgtaaaagcctggaaggaaattcgctgccttttgactattaaaattaggggcatagtattcaggcaacagtaccttctgtatgactattgacactcatattctcttttctttaaataactcaggaagagaaacattttccagagattgttcaatgattcaaggtccttacacataatcaatagggaaatggatcaaataaaggggtcctagttgccaattcttgaatttttcttaataagaggaatatgacaaaagagaaagtaagaactttctgaggaaatgttctctttgtatggtagaagattctctgctgttgaaaatggatgcattatgctaagaagtcacactacaaacatgtttaattcattcatttaattcaaaaatattaaatttatccatgctcgttataacggcaggcactctggtagctactagacatacaatattaagtgatactatatatttgccactctcatagagcttacagtccaatgagacagacagtagactaatagcaatagcaacatgaacaataaaaattaattaaaagttaataaaagtgctgggaaagcaaaaagagcatgtcatggtagagaacactgcagcaggggctacttcagtagggtattcagaacttctcccattcaaaagacactgtgcactattgtagagaaaaaaacatagcaacctgccccctctcacagctcaactgagacctagtatttcctctgagaaacatcatttccaactttttaaaatcaaagcaacatttaccattctttggtctgaccccaccgtggagatatgtttcaaattttacagatgctgatttagtgtcctatccgcagatttagcatcgcctctggaggataggtcctacaccagagtttttagtcagtcagttataaactccactctcctgatatgcaaataatttcaagcctgctattttagcattttagtatattctcttacccacaccaatcattttatagaaggtttctcaacagttgcactattgacattctgggccagaaaagtttttatggagataggggctgtcctgagctctgcaggatattcagcagcatccgtgacctctacccactagatgccagtagcacctatcccctccgtaagttatgacagcgaaaaacatcttgacattgccaaatgtgccctgggctggcggtcaaaatctgctcccctacccctattgagaaccactgaattaatacttttgctactctgttgctaggtagaaatactgatttaattagagatttaaactactcaagacaggttctctctgagttttatatagattacagagtttaagacctcatgataattaatactgaaaaaatcttttgttacttattaaaactaaaacctcattaaaacagctaaatttaaatgttgaaaaattaaaatgcatcagagcctggagtcaagtgtttaaataaacagctgaaggtgctttaggggcactcctccaggacacatgctggacaccgagacaggtaagcatcttggccactggatttccctccattgctgaaatctctgccactgcaacaaaagaacactttacagctcaccacctgtcagtgacgaggattattctgctatccttattacataattcccaggtcttccgcacttttgattctaaacagatgaagctggaagaaaaagaaaaaaggaaagaagaaagttgtaagatggatacagttgaatgaagcatagactgagatcactcctgttagggatgtaacttctcacataaagaagtagagaaagctccttcccatccttgcttgagtcgagagtttattaaattaatttgcatataatggttaatttactaatgaacaatttttcacaaactgttccagtagcacttatcaatttgtgacttctccttatgccgtagtaaaatcttcaaaaacttactcttagagtattttgacaagacggctgggcgcggtggctcatgcctgtaatcccaacactttgggaggctgaggcgggtagatcacgaggtcaggagaccgagaccatcctggctaacacagtaaaaccccgtctctgctaaaaatacaaaaacaaaaaattagccaggcatggtgtggggcgcctgtagacccagctactcaggaggctgaggcgggagaatggcgtgaacccgggaggcggagcttgcagtgagccgagattttgccactccagcctgggcgacagagcgagactctgtctcaaaaaaaaaaaaagagaatattttgacaagatgttagatcacggatgtacagtaaagagtacgatgaatatttaaaattatgtaattctcagagcaatttttaaagaaaataactattatctgtttaaaaatattttgcctgggagtataatatggtataagtatttttcagaactgtttggctatctcttacaaagttagattacatgtacctatgatcaaataaaatgaaaacatatatcccagaaaagacttgtataaaaatgtccacagcagtcttatttgtaatagcataaaactggaaacaactaaaatgtccatcatcaggagaacgatatactatcattttgcatatgtaaaatgaaatatttacctctcaataaaaaggaaaaactactgatgtatgcagtgtgatgtaatcatgtacactgtagaaataatgctgataaaaagcgaaacaaagtcatttatataaaactcttggcaggcaaaactaatctatgatgattggagtcaagaaacaattacatgtatatgagggcagggaattaactgcaataggacacatgagaattttgtggggtcatgaaaatatttcatatcttatttttaaagagtcgcattagtttatataattgtcaaaactcataaaattgaacaactgaaaatcgtgctttattgcatgtaaattataaattataaaacaatataaaatgtattacctacttatattagaatatacaaaaagaatagacaaaatcataattttttcacctgaatattattgtcaagctgtttgagaatatctttctgtttgttttaattattttttcagatttcccgaaactttaaacatagaattatcccagggctcagtccctgaatgttctttcttttctatttgtactcactctttttgtgatctcatcttgtccgatggcttttaatgttatctttatagtaatggttttcacagttcttttctgtctacttgacactcatgtaaatgtctaatcaatatctcaaaatttatctaacaatgagaccctaaactttccaccaaatcaacccttaactcatagtttttccatttcaatgaaaaaaactgattcttccagtggcacaagcctaaacctcaagttcattctttactcctccttttctccaattcacatattcaggaatccaaccatttttcactccttcaaatgctaccactctattttgcgccaccagtacttccagtctggattattacatggctaactagttgtattaggttgttctttgcattgctatgaagaaacacctgagactgggtaatttataaggaaaagaattttaattgactcatggttctgcaggatgcaggaagcatggcaccagcatctgcttgtctcctggtgaagccctcaggtagcaggcacatcacatggcaagagcaggaacaaggttggggggaggtgtcacacacttttaagcaaacagatctcatgagaactcactatcataaggacagcaccaagacatgagggaaccactgccatgatccaaacgcctcccacaaggccccatgtccaaaattggggattacatttcaacatgagaattgtgcaggagacacccccacatcactagtctccctgcttccaccctttctcctctacagtctgtttccacacagcaggcaaaatgaacctatgaaaactaagtcaaatcaagttactcctctgctgaaaatcttttaatggcctctgccttgattcggagtacaatgatgtgaaggccttatgagatttgcctgacccaacctccttcacttacctcttcattttcatctacttctactgtcgtccttaatcctctccagctatagctcatcttcttgtcccttgaagacaccaggtatgcaaacacttcagggcctttacatctcctgctgcatctgtctgaaaaatcttccccaagatgtctacattactcaccatttcctctcctttaggtcttacttaaatgtcatcttctctgtgaggccttttctggccactctagctaaaattgcaaactctcttcttccaacatcctcaatgcctagaatgaccatattatttgtgcttcagtgtaagtgacttggcaatgttctttggatttgcattatcaaatcctctactttctttccgtttatggagttgaactcaaaagggagttagggagatacacaacaattaaggcaaaagaatgtgtattctctgtaaacaaatctgaatgtgggtttttaagttcaaaaaaaaaataagtggcagaaaaggaagttgacttaaaaataaaaacctggatatttgcacaggttttggaggcccttaagcttctctatcaaagaagcttgttattatctaattgtgaggaaaatatgaaatattcactaagtaaatagttattgcttatctattaattagaagtcaaagaatttggtaatagtatgaaagagacattatgacaagatggtgagggaaggagcaaaagcacctaaaccataccaggccctgccaccatttctcctgtgtcccaaaatggtgtatctccaattcacccagcttgctcctaccacagcacttgcacaccagagaacactgctatttcatctataaggattaagtatgggaatgcctaattcttctactttagtactacaaccagtagtaaagacattcaaaattcattcacagaaaaaatggaaaacgtaaatcacaatgaggtaaataaaggcaaataacagagaaacaagaaggtaatttcataaaatggaaagcacagtgttgacacaaaaaagaattctaataacttttttatgacaataagtctttatttttcatatagaatgccagtgcaggtaaccatcagaaaacatactgcttttttaaaatatacagaactgaaaaaaagaaaaattttagcagggtaccttactatacacagaaatctaatgaacatcttcaggcactacgactaggacgtaaaatagttaatgttatttgttgatacattatgaatcactaagcattattattacaggctatctttacctgaaagcagaattacaatcattctgacagcactgggtaattctaaaatgtaggtctagtgaaaagtatgtacagccagccagcaagcaaggaacagatgccatgtcattttctgaagggacagactgatttggaacctggctctgtagattttaagaatttatatagccatcttaacagcttaatattgagattccctcactgtgtatgttggcaaccagcaaaagtgagaatttctgtaacatgatctaaataggtctaggattaaaaatgagaacaccatccatatgacagaattgcttcttcacaactgacaacaattgttgcccagttctcacctgttgtcctgcaaaaaccactcacctgatgagttttctcttattgaattgcattccactacatattacttatcaattaaatattgcttaagtattcatgaatgcatcctgtgatggctaatagtgagtgtcaacttgattggattgaaggatgcaaagtattgatcctgggtgtgtctgtgaggatgttgccaaaggagattaacatttgagtctgtgggctgggaaaggcagacccacccttaatctgggtgggcaccatctaatcagttgccatcatggctgtaatataaagcaggcagaaaaatgtgaaaagacaagactggcctagcctcccggcctacacttttcttccatgctggatgcttcctgacctcgaatatctgactccaagttcttcagttttggtactcgaactggctctctgctcctcagcttgcagatggcctattgtgagaccttgtgatcaggtgagttaatacttaataaactttcttttcttatatatatacataaactatatatattatatatacatatatatatatatatatctcctattagttctgtccctctagagaaccctaacatatatcctttcctctccattttctctattacatctctctgtgtgtgcatgttatgtatataaatgtttcaagtcccaccatgtcttatctgcccaaatacaatagccttcttgtaatctcattttgtcattctacttgctcctcttgccagtgtatcaccaaaatgaactttctaaaaggcaattcagatcttgttactctcccactgaaattcttctgaagtccttctacaaccttggggctaaagtcaacaagtccttatcttacccttaaagtcctcagcaatgtttgtctttggtagctttccagcattttctagtcttctctagtcgttcataaagatttacgttttggccacgttgacagaagcctctgcaggatatggagagagtacatacaaggtgggcagaaaggtttgtagaggaagctttctggagggtggagagggagagggagatgatgtttcccaaacaagagagcagggtgaacagaggcagacacaggaggcacaaggcctggtaaggaatcaggatgtggttcaatagatctgaggcaaaggcttacaatacagtatgttggtgatgggactagacaaccccaagttaaggaaagaggttgaagggtaaattcctggaaatctttttatgccaaggtaaggaatttgattgaaatatggagaggccattatcattctactaaaaacactgcagatttgttaagagaagagatggcaaaaccacaagagttagcaaagtcttccctgaaaataaatcattttgtgcttgatcacagttatattaaggttcataattataaagcatcatatgtgtggcctcccttctacctttcagcctgctataataaattatcacagggccaaattaatgttttaaaaacataaatcagatcatgtcacttccttgcttaaaagctttcatggcttcctagagcatttagaataaaatggaaaatccttacccagtcttcaaaagtcctaaatgatctggcccctgactaccactccaaccctgcatctagccttccccatcatgcttatgatgacacttcagccacaggggactcacttctgtttcctaataatgcacacatccatccttctatagggattttgcacttgttctttctgcctgaagttcttattacctgattttttttattaagactcctgcttgttatccagatttcagctcgactggcatcctctcataattaccttatttgtgtacttgtttattatctgtctgtctctcatgctagaatataaattccttgaaaagggagatatcctctattttatttattgcttaaatgctgctactcagaaaaattcatggcacttaagacatactcaacaaatacgtgttgaatgaataaaagagaagcagaaatttctgttttataaaagtaaaaaaacacattaaagtagctgttactttgtgttttatatatgtgtatgtcataaatatgtacatgtacatgtattttttacttctttgtaatgaattagcaaaaatgaaaaaattaaacatggcagctgcaaaaaataaataaataaataaattaattaattaattaattaattaaatgtgaaagaacactaaacgtcaaagaaacaaatcagaaaaatgtaggtggtcatgcattagaaatatttagcctgtgaagtttgtctcttcctattcttgcgaacgaaatagttgtaaggagaataaaatgaggggcagaaagaactcatcctttatcccatctggagagcttgtacaaagagagacttagaagaaaggacaagaaaacatgctggggtcacagaaggaaactgagttgaaaggagggaaaaaatctgcattccgagtcatttggaacagagaaggaagagagacattatctgaagaccatgttcaccagaggcaaaaaggctgaaaaagaaatcgacatctgtgaaaggctcgtgcaccccacatctgagggggcagatgaagattgtttatgtagcacaagaagatgttgggagaaggaaggaacaggctcacatggaaacatatgctctccgaagcgacttgaaaaataaagcatgcagccgagagagaaacatctgtgttgcacacgggcagaccaccagtagtgaagcagactaggggtagaaggaaaaggcgtacacaaacaagatcggacattatgtcttgtcaaaatgacatgtaaaggcactgggtctgcatctcattctctggtgagttaatgggaactcagccacctggggaaatcacggatgagtaaattagctgctttactgttttcatagttttgcagaaatgacaaagtgttcacaggtttcttcagggctttttattcctgctggaaaaaaaattctttagagtacagattatttatagtttttgagaaacatattgtagagctcttattccaaatctcctgcaataatagacgcagctggatttctcatcctttgaccacattttcagtacataatagctttagaaaaaattatttcacaatagtcaatgatcgtaggaatttcatatagaattaaccagatatcagtttccattaggtattaagggttgacaatgtgaaatatttattttaatgatacatactaaatttttaaaactatacttaataactaaaactagttataaaatttaatagtttcttaaattatagaaataaattttcaagtctttgctattctctttatactaactcaattttattggttaaacaaaaagttaaacatttttaaaaaggccaaatgacaattgactattggattacatatagcttacactataattttattatgttgtaatttgctatgactttatatatatatacatctgtaagtttatataaaacatatagtcatattcatctttacacagacatatacatagcataattttatatgcagatataatttttattataaataccaacttatttttaaaagtgagggtctcagataaggaagccaaaatgaaaagagagaagtaacttcaagtatgtggtatctgatatccactgcacaattcctgaaatgatttttttttaaattacataaacatgtagaaaacacaaatatttaaggacagaaaattattgaaattataaaaatacgttttgtggtatcttgatagtataagaatgtcaaagagctaagcatacacaacaatcagagagaaaaaagtaactgcagggtaaatatagaaaccatagagtacctttagaataagtgtacggtaagcgtgaatcaaccacggctgagaaaaataaactgaaataaaaatccattggtctatattgcagagataataaaccagatcctggtaaaatcccaaaagttaaattggtgatgttcagtttttacaacatcttggtatcattcctgcctttctctctaaacaagtgcccactgcccaacactccattaggttgttgtgagtgtaattcacaaaacttttctttctcttcattcacctactcttcatattaccactcttatgtattacttcttcagcactccttgatatctgctgtggaaggaaaggtgaactaacatttattaggagcttactaattaccaactttttaatgtgttatcttaattcttatgacaaccttataaggttttatttttttcttttttaaagacatggaagctaatacttgaatatagtagtgagataaaataatgaattaagacttaaaacagatatgtctaacttcaaatatcatgttttttctctcacactatattgcctatctaataaattactcctgactgcattattaatatctaataatgacatgtcatgattccaaattatcattgtcaaatgccaaccagttcaaaaagagtcttcttttgcattcctctaactattcaagtgatatatgctcactatagaaatttataaaatataaaataacataaagacagaagaaatgttgctgtaacaaatcacacagaggggaaagtcagtcactgctaacattttagaataacacctttagttcttttctgctccttctgtatgttgtgctcctttttaaaatctacaaaaacaactgatatatttgaaaaatttcaagcagaatagtaatcctttgaaaaatgtcactttgataaagtatttcccagtgtctcaatcacctatttcatttaatggtgaaattttcaccagcaaatagcccaattctaatattcaaataaaggaagactagagattgacttacagaatggtggaatgaaaatctcagtgaaacactcagtctctcacaaaaacaacaaaatactgacaaaacaataaaagtaatcatttctagaactccagaaattaaccaaagccaaaaaactatgttataaggccaatatattagaacagacattttaaggccatgtgctgccttattttctttgagccttatagggcccaaaggctcagcaatgggtttgcttgatcttggcagatatgcctccctcccagcaggacaggttcctcactgaggtgattctctatccactgcatcagctgcattctacctggccctctacctaaccagtttcacctcctttccagcctgcaaaattattcaaatgagccaatcacattttcctgtcagaaataaggagcacaccatccttctgttattacaaagcttgtccttcacagtcctttctggttcactctatttccaagcaccactcccatgtggcatatggtgttctccctccccaggctgagtatatgtaactaataagctgctcccagtctcatctgcccagcgtcaaatgtaatgtatttggccattttgtattgtttagcgcaaaggaaccctccttcacccatggggtcaatgggagtgatcagaatataaataaactgaaaatcatctatgcaagagaaaatactgaatctctttagacaacaggcatctgtgacatttagattgggctatttccactccccagctctccacatctcagtagtgcaataccgtgaaaagccagccatcttgcagccaagatggaactgcactctcttggaactcaaaaaacaaaaacaaataaacaaaaaaacagcattcatcctcagaacacagtaggtataatgtccaaacatccagctccatggaaaatttcttttctcagaatgttatgactattagatttaacccagatttcagcttagccaaggtaaagaggaggggagtactatccccaggtcattactgaaaccatgtcaaactgctcacaatattgcagcagcaaccaaatttggacagtagagggaggtccgataacaaggttgttacaatattattatggactgaaagtctgtatcttccccaaaattcatatgttgaagccctagcatccagtgtgactagatttggagatgggcttctaaaataataatcaaggtaattgaagtaaaatgaagtcataagtgtgggggaccctaatctgacaagattagtatctttgtgagaagagacactctctatatataaaactctttttctgttgcccatatgcacaaagcaaggaaaggccatgtgacctcacagagaaaaggtagccaaccaccaaccaagaggagaacccttacaaggcactaatgcctgctggcaccttgatcttggacttccagtctccagaactgtgagaaaataaatttctgttgtttatgtcacccagtctatgatactttgttttgacagacaaagcaaactaatatagatttattagctagaatatcaagttttcaaaaaaaatatgagatatataaaataaaacaagaaagtgtgccccataaaagagcaaaaatcagccaacagatcatttccctgaggggacctagatttttgacttagtagataaagattttaaatcacctttttaaaatgtgttcaaattacttaaggcaatcatatctaaagaactcaagagaacgatgacaatcatgtttcactgagagtatccataaagagatataatttttctgaaaagaaccacatagaagtaattctgcagcccaaagataaaataacaaaaaagaataaattattagatgggctcaaaatcagactctcactggcagaagaaaaagatcaacaaaattgacagtttaagagattatccgttttgaaaggcagagaaaaaagcaatgaagaaaataaacaggacctcacagacctgatggatatcatccagcatattaacatgcacataatgggaatctcattaatagaaaagaaagaagaagaaatgatatttgaagaagtgatggtcaaaaattccaaatttgatgagaaatattaatcaacacaccctagaaactcaatgagttccaagtaaaacaatcccccaaaaaatcaccacatccagacatgttatagtctaattgagaaaagtcaaaaaaagagagaaaattttgaaaataacaaaagaaaaatgacttattatatacaactaatcctcaagattaatggctatgttttatcagaaaccatggagtctataaagcagtgggataaaatattcaaagttctggaaaaataaaatttacaaactaataattctatatccagtaacattatccttcaaaaatgaagaaattatggcatttccataagaacaaaaacaaagaacttgcgattaggaattctgccctgtgaatatcatttgagtgcatccttcaagctaaaatgagaggacactagacagtaacttgagtccacacaaataaatttaaaagcatcaataaaagtaactatataggcaaatataaaagagagaataaatgtctttctgtttgtaacttttccatgatcttacttaaaagacaattgtatgaaactataatgataaaattttgctgatgggcttatgacatctaaagtgtaatttgtataataattgtagcacaaagaaagataatatatctctgttatagcaaaatgtttgtatgctattgaaattaagttggtataaatttcaattagattgttttaggatactaattattagttataatctcaggcaatcactaaaaaaacactaaaaactttaaaaacaaggaaattaaaatgacatatagaaactgtattttaaacacaaaaggagacagtaatggaggaaacaaaaaaagataataagacatactgaaaacaagcagcaaaacatttaatgtaaatccttccttatttataattgtaataaatataaatggagtaatctcttcaatcaaaaggcagagatcagagggtggatttttaaaaatctcatatgtttttgatatctatgaaaggcacactttagattcaaaagcacaagtaaattgaatgtaaaagggtggaaaatataacaaaaaaaaagcttagagaactacattaatattagacaaaatagaccatagagaaaaaattgcttctagagatacagatatttttaaatgatagatcaatctactaggaagtataaatctatatgcacctaacaacagaattccaaaataaatgatgcacaaaaagacagaattgtaagaacaaatagaaaagataacagtattagttagagatatcagtatcttactttcaatattagatagaaatttgatgaagggcaacttcacttgttaattagaggcaccatgaaaatgcctgctttctggtataggatgcctacaccaagcaagctttttcacacatcatctcctttacttccatcatatccatcatcatatctcaacatataccttaaattcattgacttgttctctgtataaatagtgtcaccaccctagtccaagctactataatctttccttagcctagcctaatatattcttataccaatatctctcacttatctcttttcctcttcctgttaatttttcacacaacagttagtgccatgaaatttttatttttatttttgtatcatagcactacacctgaaacactttataagcttttcattgtatttaaaataaatttaattttttttccatggactacagagatctgcattaccttggcctgcctaattctccaaactaattttaaatttctgattcttcatcttcttgccacatgacgtctttctgtttatcaaacccaccaagctgtttttcagctttactttcaatcttgctagtccttccatgagatatccatcaaatctcagcttaaagatactcttccccagagagatatttcttaatccaaaccacatccctttgccactctctttcactggtctctacacattttttttttccatcatagggcttattactctttcttattacatatttgttagtgatattacttgaaaactgaattcagtattcatctgttttacctgatgtttttaaacaattcaacctaaggcaaaatatataccacagaatttaatttaatatggaaaaataattacaatgaacataaatgccttctaaattattcagactatacttctgttctgtgaatgattcatgaatctctttagatttatgtcacctttaaaatatgttttctggctaaattctgcattgatatctctttccctaggatcaaaaattatttttatctctggttattctatttccctcactgacaacatgcataatcctcaatattctaaattttaaaaaaatcattcaaatattctttaatcagaccttgaatgcatatcctttcatgctctttattattaataatgacaaatagttcatgatttatgatcatttcagagaaattttgaggcacattaaggaacattgggctaagatcttgaatttctcatcaagttgtacctgtcaagtgagtacaactaaaaatgaaaatgtatgcctataaaaatggtatatgttttaaacacttctcttttcttaaaatggttgtaatagtaacactttttacaataaagcagattgaaactttttcatgtattttatttcaataaaattttaacagtcttttccatttctgctttttggaagttacagtgacctccctggaaaatcttttttcactaaaagtgattgatcaaacagaatgtttggctagaataaagtatgttacatttattcacactccttcaacatttggggccatttaaacaactttttccgactgacatcaatacatgaaattgtgcacagacattatttatcagaagttaattatatgcaccaatattcttttggaaggaatatcttctgattgtttttcacttgcagtgtacaaaaagggtatatctttttaatttgtaaaactatataccacttatgttgtataagaagttagttaatatcatataatttgccaccatataacttaccattatgtaattgccacatggtcagtgatttctatctgccttggccagaaaatgattttttatgaaaacacatatatgcatgtctacatgcattaacaagatattttggtgaaaatatttcattaaaattagtatatgagtagaggatgaataatcaggactctatattttaatgatcctgttcatctgctctgta

SEQ ID NO: 71 - DNA, 178080 bp, Homo sapiens
gctatgtctacatcatgtgaaatctccagatatctgtaagcaaacagcaatctaagggaaattttctgctttttcctggatatttgacatcatgtagtctaaatctggcagtctcctaaatacatgtcttctttcagaattctatattccatgtttttctcatattacaacagcagctaagacatgtcagtcactctccttgttcttggagctatagtagctcttgcaagtgaggttgattttgatgtatgataagatttctagacatttcaaggggatagtataatagctaacatgattcaaattatagtttcatcctatcatgggaactatatatttttaaatagaaaaagtataaagaatattattcaccatagtttgtaaataaaatctgtatggatagatgtattgtttcccataagagttatggtcacattagtaaatggagtgattctagttctataaagctgtagtgaattattgtaattttgtgctgccttagcaagcattttgaatataagttggacttcctcatacaaaaagcaaggcttagttgcccttaacataataatagtttccagctctccatatcctcccatttcctcaaggttgttgatgtagatatctgccctatacaactgcctgtaatgtgacaggtcccccaccttgattacttaagggtggatgtccgctgcttactcgctgaaggccaagcagtgaaccaaggccagggtgtccagttgaggttcaggtgcccctgagaacccaaacatccccgggcataggtaggaacattccaaggaaaacagtctcatcacacataggcagtagccaaagagccagatcattagcttgaaagtagcttggagatggatggtgacatggatttctaaaaatgtcctgctgccactcaggagtgcactgtatgtaagtcctaatcaattcatctactcgccaagctggacttactcaaatcattctttttgtctcttggctccttcccagtttgggaagggacattacagatttttctcataacaactggtgtcactaacctaggatctaagagaccaaatgatgaatcaggaaggagcatctgttgggggaatcacagggtagtcagaggcataaatgtggagtggagttaccccactgctcaacctttgtgggccactgtgtggggacagggatgctcagacaacaccactggggactgagtacctattacaaaaaactaagatgttaaaatatgatatggacagcaaatatgccatgtggtaaggtcggctactgagaaattgttagagcaggaaaggaaagaagggtagaatttcctgtggcttacacatttaaaaagatgaaaaagttcaaagccacaacagattttctaggactccagctggatgcaggcccatccttgcacacagtttttaactgatgggcaaattacagcaagaaaaaaattcaaagctcaaatgattaacctgcaactatacagttaagtagagtcttctagatttctctatttctctcttttcttttttgcctgctttgaatctaccgttattaagctacttgtgttgagataaaactcattgtttatggttttgctaattcaacgctacatggacattttatttttcttattaaattcagccagttccagctaaaatgtaaacattggaaactcctatgaaactgcagaagaaaaggtaaaagagcttttaaaaaatcagactgctatggaaactgctttactccaaattttttttctttccttggattatttacagggggaaacaaagtttagccatgtgacaggttgtaatttagtcaaaaataatttggatcctgctatctttttttttagagatggagtcacactctgtcgcccaggctggagtgcagtggcgtcatctccactcactgcaacctccaccccctgggttcaagcgattcttctgtctcagcctcctgagtagctgggattacaggcacctgccaccctatctggctaattttttgtatttttagtagagacagggtttcactctcttggccaggctggtcttgaactcctggcctcggatccacctgcctcggcctcccaaagtgctgggattacagatgtgagccaccgtgcctggccagatcgagctatcttttaagctaatgaatttatgctgctgtctcatgactagagttttgaaactattagatcttttgtgcatgtatacatatttaaatgtatttatgtgtatgtacctgtattatgttatgcattgtgtctatcatgctactaaattgtcttataagtaagtgattagtcatacattaagttcaaatgcttttcaagttcacatgaatttagtaaactttaataaataagctggctttaaaattactggtaaactaaaactaaaaattgtcttcagaattgccagcatacatttttgtctgagcttactgattaggtaactctaatatttgctctgttggatttttttttttttttttttttttgagacaggttctcactctgtcacccagcctgcaatgcagtggcacaatatagctcacctcagtcttgacctcctgggctcaagtaatcctcccacctcagcctcccaagtatctgggactacaggtgcacgtcaccatgcccagctaattttttaaaatttttattaaagatgaggtcttgctatgctgcccaggctggtctcaaactcctgatctcaagcaatcctcctgcctcagcctcccacagtgctgggattactggcatgagccgccatgtttggctgcttccgctagatattttaaggtgtcagggtttgataagaaggttttaagactataaacctagccaaaaacatattgatttttgtttatgtaggtttttttttttacaaatatgattaatttaatatgaacagctaaattttctgagttattggcaaaaatgcccatgtatccaactttaatgttctttcttcagtaaacacctgatagtcacaggctataaaattggttaacaggaaaataacttagaatcatgattagcttctataatgtctcagttctcacgggaatctaggtgaactgctaaaaataaaagaattgggtaaatgtaaataagagaaatgcttgtaggcaagctttttgtgtaatttaaaatcaaaattattttaggtactcattgaatgtttgggtcatttccaattaaaaagggttataatatggggcattggttacacttttgagcttgttcatgaaatctatcacggggaaaagtattagcagacttcactgagctgaataaaagtaaggactgagtctagaaaatattcaaaaaataaaaacgggatgggccaaatgggtgcctgtatacttgtcctggcccaggcgggcaatgaacatgaaacaatactgccagggaaacactgaagtcatccaaacaatccagaaattacataagacacaagcagtcaggctggcccagtgctcttacaccagccccgtgtggcctgtgaaaaagccaggtggcacctggtgaatgacggtagactactgtgagctaaaaaagtggtgccctctatacaagcaactatgcccagtgttgctcagctgctacagcaggtggtccttaggctgggaaatgtccatgctgtgattgaattgactaatgcctttttcagtattcctttagcaaaagattcacaggaccagtctgccttcacttggggggccaacgatgggctttccatgtgttaccataagggtacctgcacaggcccaccatctgtcatggtatgattgcataggacttctctagactctctttgcctgccttgatctccctttttactatgtcgatgttatcatcctaacctcagaatctcttgctgctctggaggcttccctgcagactgtctttggccagcctagaagacaggggatggaaagtcaactccaaaaagttttagggatctggcaaggccatcaaagtcctgagagttacctggttgagtaagatgtaaaacacacccagagctatcattgataagatagcacagcagcctatttcctagacgataaaataacttcaggtttttctaggtttgctgggatactgaacaatattcatttctcatttggcacaaaccctccactcattacacaccctattataaaaagctgaaaagtgggactggacacacatagagcaagaggcttttgccaaagtaaaactattgggaaagcaaacccaagcactaggttccccactgccacagcaccctcttgtattagaagtcactggagatgccacagggatgaattggggtttgtggcaaaagcaaccaatggaaatggtagctgtagggcttggatctcaattatggaaaggagcagaatcttgctatacagttttagagcaacagctattggccatacatagaccattgcaacaagcggaggccatcaccagaaagcagaccatcacagtaaaaactgccactcattcaagagtgggtgaaaggcattctagctaagcctacctccagggtgacacagtcgcacctatctataataaaggggtgccgtgtcaggcctgtaagtcctttaagtcaggcactgcaggaggtgcttggacccatccactttaaacaagtagaggggactggcatagcaatggaaccacctaccaggccaaccactgtgtccgaagggacctgctgagaccctctagggcccggtacactgatgggtctagcaaaggcaccaacaccaatggtcaacagttgtgatgcaaatggagactgacaccatatggataaaatgggcatcagaacaaaacttagaccagaggtccacttaccatataacccaacaggcacaggcatcactacaaaaaagaatggcttgctgaaaacccaattacatgcactgtcccaattccatgcattgtttttaacccaagtacatacttaaatccctggactaagaatctccctgaagtcacacaaaggttagatgagtcacccactaccacacatggcatcatatcctgtgactggttggcacggactgtgaaacagacctcataaactctcagggttacctctgagtcactgagtcatgctcctgaagcaggtggtcagaccatgctcctgagagcaccaatggatctgctaaacataactggctatgtagatctgaagttgagctggacagtgcctccaaactggatcagttttatggcactggagggtgccatgaagactgctggaggggaggtggtcacagctgtgctccttgatggatatctgagagccttatgataccaacacgcagcagcaccaatatctgctggagtgctcacagggcaggcagtataggcaaggctggaaacttaccaattggctagtatgcttgctcctaaaagggaagccatgtgtggtacggtaagccaggcctgaagcccattgtgacctctctaataaggcccatgaaaaaaatatagtggtaataatgttacaagaagtggatacacccataagggtccctattaaatacctgtgttcacttccataggctgttgctcctactaaccatgacagttggtaatgccttcctggactgggctgattatagcagcagccagcaaccagtctgattgtagcatatatgcatacctccctgctgtcaaataataataatatgccttgaaatactctgcatttctcccaatggaactggagtgactgattcaacagaacgagtaacgcaccttgggctcagtagggactgcatccacctggaggcccaattgccaaagtgatggagacccaacaacatacgcctttatgggcactacctgttgagcctatatccttgataaagagaataatgttacaaatgcttttttttttttttgagacagagttgcactctgtcaccctggctagagtgcaatggctcgatctcagctcactgcaacctccgcctcctgggttcaagcaattctcctgcctcagcctctcaagtagctaagattacaggcatgtgccaccgcacccggctaattttttgtatttttagcagagacggggtttcactatgttacccaggctggtctcaaactcctgagctcaggcaatccacctgcctcagtctcccaaagtgctgggattataggcgcgagccaccgcgcccggcccacaaatgattttaaatcatttgtcaattcagatccatgataaaacctaattagatttctttacctcattctcaattggttatacactttacctactcattggagttatgtcttgctaataggcatgatcactgtagttagcttttgcttttgatgctgttgtgtgtactgtggatgtgacttgtacacacaagccaatgctatagggtataggcccatataattctttccctcataccccactcagagactgtggtccaagattggcagaaaaaaaatgtgagagttgagggacagggtggattgtagtgtgatgggtcccccatcaggttacttaagggtgcatgtctgctgcctgaacctgaaggccgggcagtgagtcaaggtcatggtgtgcagctgaggagcaggtgtctctgagaacccaaatatcccagggcatagctgcgaacataccagggaaaacagtctcatcacacacacggaaggcaaagagccagaaaattagctgaaaagcagcttagaactgggtggtggtgcagatctctagagctctcctgccactgcccaggagtgtcctgtatgtcagtactaataaactcatctacttatcaagctggacttgtgagagtcattctctgattatcttgactccttcccagtttagggaagggacattacaatcccaggtttttcttataacattgcctcctggtgaccacctcactatgagacagctggatccagcctacttgactggcaccactgaccccctggactatgcagttatgccatagtgaccaagtcacagccacagcatgactccctggaactgcgtctgcttactttaaactcaccaagtagaactccctgggggaaatctgcctgggtaatgccctggatcccagtaaaggcttcagcccacaggtccctcacacgcactctctctttgtctctctttctcttgttctccacccacaatctgagtgtacaagtcccagacagctttcttcttcctgttggccctgtgaggtgtgctgccttcttctctgggagaagtaataaaaactacttctgttacctgtgtgttcttgcaaaagataataaaataataagagtgtgaaaaaccctacctctgttatttcacgtgttttcttatgctgtctcctctgtctcccctgatcggcacacttgacccaactctcctcctggtcagggctctcctggagagtggctatcttggtaggaataaactggacagaggtcatctaagagccaacagggcgtctactggaataaacatgtttcctgtgagggggaccctggtcacagtttggacacataggcagggggcatccttctggatgaggcagcatcctgagaaaggcacattgtccacaaccaggcctgcttcccctggtcccatcggggcagggcgagggttgccactctcttcggagaaatctcaagacaaaactggaggtaaatactagggccttggataaaattagtttagccaattttaaagatattggcattttctttttcttttcttttttaaagatggggtctcggccaggcacggtggctcacacctgtaatcccagcactctgggaggtcgacacaggtggctcacctgagatcaggagttcaagaccagcttggccaacatggtgaaacccaatctctactaaaaatacaaaaattagccaggcatggtggcgcatgcctatgatcccagctactcaggaggctgaggcaggagaattgcttgaacccaggaggtggaggtttcggtgagccaagatcgtgccattgcactccagcctgggcgacaagagtaaaactctgtctcaaaaaaaaaaaaagacgaaaaaaaaaagacaggggtctcgccatgttgcccagggttgtctagaacttctcagctcaaatgatccacccaccttggcttcccaaagtgctgggattagaagtgcgagcccccgtgcctggccgatattggcattttcttattgtgaggtgagcagagaaaaatctgtgttgccaccatttattgttacattttttttttgtacaaagaagtatttaaagttgctagaaaagtaataaaaaataataaaaattgtctacatggtataaatccccttgggcattaaattcttgtagatattactggtatgctgagtaccctcaatgtgtgaagtaaaaacataaaaagtgttttatccaaacctgtctctcaaataagagaaattagatcacatttcccactggggagaagcatcctgaatgccaccctggctgtactccataccttagcctccagggtcagatatcagaacacgcattccagtatgtaaagttcacaccctgttttttggttttgattttttatttttaaacttcaaagcaatttttctttcctcctccagggcagaccagaacagtgggtgattttcctcctgccattttcttgggacagtgaaaagtggagaagagaatgtttaaattgttgcctgctggggacacatcgcactcctcaatttgggtggtgccaaccgctgttggaattagttatctgtgagtacagtaaggttgtatgttgttccgatgtcccatggtaaggaattattctctgtaattctcttgggctttgcagcccttgaacagctttgttcttctcttctggggtcatcatgccgagttctctggtgtataaggtggtccagggaagtctgtagctgcagtgtctactttttagaggccaaaaccttaagccatcagacactgggggatcttccatgtctcctaagggggctggctggcatttctttaccacattgtctctctttacgtttcttttccactgctacagtacccaggaaaacttctccaagtctatggtaagcagacatccacccagagtcaaaatgctggtctcctcttctagcgtaggcctccagtcttcacaagggactccctgaggtcctcctccctggccaaagggagggaaggtccccttcagggaagagtaagaacagcttcttcagccacctctgctccctgggtctggtctctttttctgttgctgaggatagcaggaggggattctgggagagggtagttggtgatgggacccattctcttaccatttcagtgagaaaagtgagacagggctggcctaggcaacgatctgaacttagaatgtgagaccttaacagcaattccagagcgatggcaacacacattcttattaaacgagttagctttatagtgatggcttgtttcatatctgggttgctagagcctccaggtaacacaatagaaggaatgtgcttagacggcccagagcatcagtccacactttcagttagaaagcaatgaatgtatgtgaaccaggttgttacatcaactcctgtctagggcaaggtggtgcgtaaatgagcccttgtatatcaacattttattttcattctgtactcttacattgatggaaaagtgaaaagttattatgattaatagtagctggattcttccctgtcagtgctaagtgatgatatagaaaccaaggtgcaaataaacgcaaatactcctacagataagtatgatcatgttcctgaccttttaacgttgtttatgccgtatgcacattctaaaattatcatttcctcttttatttgcagagctgaaattttgtctttcaaaggactagtgcatcactctgctgcaaagcttggaaaagctctgatagcctcaagtctctgctctgcttttgtggtggagccttggacagacgtggaattaaggttgttggaatcagaattgctattcctccactgcatagggacaggttacaaagttttagttgtcaaaaataatttgtccaatgagaaagtactttcctctatcctaacctcttaattcattgtctatctctgccagatatgtgtgtgagttaacccagatggaaaatgaaactttgtgaataagtgattcatttttaaaaaccacttttcttaacatatgtaaaaccaaattgtttgaaagtaacttttgcttattggaaagtctagtatcttaaaatctcaggcttcttaaaaaaatgaacctttcattttaaagtagatttacagaaaatctccagaaaagaaaagtgaagacagtacagaaagctctcatatactccacatccagtttcccctgttattaacatcttacatgagtatggtgcatttgttacacttaattaaccaatattgagacattcttcctagctgaagtgcatgtgttcatcattcagatttctctagtttttggctaatgatgcttttctcttccaggatcccgtccaggatcccacattccatgtagtcactgcctccttaggctcctcctggctgtgacagtttctcagatttcccttgtttctaatgattgtggcagttttgaagagcaccggtcaggtattttgtagaatgtcccttgtttgggattttgcaaatgttttcttttggttagactggggttatgtgttttggggaggaagatcacagaggggaagtgacacttttatcaaatcataccaagggtgcatatcaacatgacttgttagtgtcaatgctgaccttgatccattggctgatgtagtatgggtcaggcttttccacagtaaagttgctgtctttattccccttttcattgttgtattctttggaagtcactatgtacagccaacctttaaagggtggggagttggctgggcaaggtggctcatgcctgtagtcttagcattttgggaggccaaagcagatggatcgcttgagcccatggaggttgaggttgcagtgagccaagattgtgccattgtactccagcctgggtaacagagtgagaccctgtctcaacaaaaattaaaaaataaaaataaagagtggagagctctagttcaccttactgagggcagagtatctacataaattatacagactcttctgcacaggaggttttctagtcttctccacttttaaattcattcagtcatttatttatatgattcatgcatatttcttttttattttgggttaccatccaatgccaccttgtttgggttttttaaattgttccagctttggccattgatgagcacagttggatcttgtgtcattttgacaaactcccactgctttttgtgtgtgtgtgtgtgtgtgtgtgtgtgtgtgtgagaagcactttctggcattacaaggtaatcctgccttttttttttttggataatccttttttatcttttttaaaaaaagttctgtcctattgatataatttggatgtttgttgcctccaaatctcatgctgaaatgtgattgccaatgttgaaatggggcgtggtgggaggtgactggaacatgggggtggatccctcatgaatggcttagtgccaccttcttggtgatgagtgagcttacattagatctggttgtttaaaagagcctggcacctccctgcattactcttaccatgtgacatgctggctccctgtcaacttctgccatgattgtaagcctcactggaagcagctatcagcaccatgcttcctataaagctgaagaacagtgagccaattcaacctctttgtatactatgcagcctcaggtatgtctttatagcaatgcaagaatgacctaatacacctgtcttgagtatttcctgcctcagccctagaatcagccatttctccaacaagctctggttccttttattggtgaacagtgtgagtccaaaagtatctgagacacgtctcaatcaatttagaaagtttattttgccaaagttaaggatgcaccagtgacacagcctcaggaggtcctgataacatatgccccaagtggtcagggtacagcttgcttttatacattttagggagacaggaatttcaagaagccaaagaggagtcttgctgtgttgcccaggctggtcctgaactcctggcctcaacccattctcctacctcagctcctgagtagctgggatcacagtaggaactgcctatcaagccccgctgaatactgagtctttccatccctttctgtctgtgttccacacaaatgttctacttaactcttcagcagacctgacggatgctaacttattacctctctaggcttaactcattttatgagtctcacccatttcagcttttgtcttttccatagcataaacgaatattttccaaaatacagcattacgtaggtatgttaaacattacacacacattacataggcaaagaaactgtagttagaagtcacaagtgcaacaaagtttctccttttagggaatgggagctcaagtgatattaaatagatagattggttgggaagtggaaaatattgaaaatgtcagatgtgcttccaaatgagggtatggtatttgatccaaaggctacatactggttaatttactctgaagagctgaagtttattcagaatactctgtttttctttccaaaaaaaaagtgcaaaagacttcacaaggctggaggagaaggagctaagaggtggcctgttgcgaaagggtctgcaatattttacccctccttttttttgaagagaagcaatctcacaaaggtgcaactatcttcatcctaaagatattcctgtcaagtgttacaacctcatttagcaacttcttgacacttgtgaggtaaaagattccaaatctctgtatggtcaaagttatgtggagccctatgaagactggtgagttctgcccttgcttggtagaagtggggcagtcagagctgctttttgggaggacatcatcttagcactaggtcctgaaagagtcagtagaatttcgacaaactgagaagacagagaacggtgtgctaaaaaagccagcagcccaagcatagcaaggaaagtgcacagcgtgttcggagaaaatgattcgtctgctgcatgaaacggaatggaaggaatggagtccagtactctgtgcagttagaagcccagcctgcaagatgggctcagacagaagcagagggtcataggtagctttccaggagttaccatcagactttataacagcactaagcgggtgctgttatacagctttgtggagcacatgaatattatcctctaaggtgtgttgctagcacctttggggaagagaaactatagctggatatgggtagtgaaagttatgaacccagaacaaaaggtgttcagatttgctgattggcagggaagttctgggagcttcacatattctacagtcttgtatttcttcacaataatcccatatctttttttttttttttttttgagactgagtctcgctctgtctcccaggctggagtgtggtggcaagatctcagcccgctgcaaactccgcctcccggtttcaagcagttctctaccacagcctcccttgtagctgggattacaggcacacccagataatttttgtatttttagtagagatggggtttcaccattttggccaggctggtcttgaactcctgacctcgtgatccacccgcttcagcctcccaaagtactgggattagaggcgtgagccaccgcacctggcctcccatatctcatgtatacaacatttttctttccattttacaggtgatgaaactgagacccagagaggaaagctcattggcccaaggtcacatagcaaataggtggcggaggctggattctatgtgcacacccttgactggatgctttcaacctcatttttttttcttttttcaaagtgagcttcaaactttcacattttgaaaactgatggtgccctaaattacaatatagtgcctgtagcttactagctaccacataaatgaatgttgaataagtcaatgactgaataaatagatggctgaatggaagaggctcccattgaaaaagaacatccttttggctctgaaagtctggaaacacacagaagaaaaaaaggagagagagagaagctctgtgttttcatattcctggaaggctacagaaaaagaagtgaatacaaatttgtaaaaatctgtataaaatctagccaagtgctgtaatctcagctacttgggggctgaggtgggaggatcgtttgagcccaggagtttgaggctgcaatgagctgctattataccactgcactccagcctgggtgacaaaatgagacttcatctcttaaaaaaaaaaaaagtataaaatccagtgaaagattaccaaggccgggcgtggtggctcacacctgtaatcccagcactttgggaggctgagatgggtggatcacctgaggttgggagttcgagaccagcctgaccaacatgaagaaaccccgtctctactaaaaatacaaaattagctggacgtggtggcacatgcctgtaatcccagctactagggatgctgaggcgggagaatcgcttgaacccgggaggcggaggttgtggtgagccgagatggtgccattgcactctagcctgggcaacaagagtgaaactctgtctcaaaataaagaaaaaaaaaaaagaaaagaaagattaccaacataaacttgccaatgttaattttaattttaattttaatttttttttgagacagagtctcactctgttgcccaggctggagtacagtgttgtgatcatagcttactgctgcctcaaactcctgggctcaagcaatcctcccacctcatcctttcaagtacctggaactatagggatgagccaccaggcctggctaatttttatttttttacagagacaggggcttactgtgttgcccaggcttgtctagaactcctggacttaagtgatcctcccaccttcggcctcccaaaccctaaaattataggtgtgagccattgtgactggccatattatttttcttttccttttttttgttttagttacaaaagggatgtaaatgtgtgtgatcagagcccagagcaaccttcaaaagcctttgaccattacttttgatttttggtttccagtgtaggactttccctagaaatctgtttctagtaacctacacagtttgaagttgtgaatttctttttctgtcctgcagagtcttgcgcctttgggtacatgatgatgaggaagagctagctgcaagaccattcctcagcagtagtattcagttcctattcataacagaatgacattgaaagtacagtgactgcatttgtttattttttaaaatttcccagctcctacaactgacagttgctatattaattgcacaaaagtttgcacaaagactgagaagatgactgaattgaaattaatcccacactgtcaattcagtagtcatgtgaactcacatctcagaaacagtgggaagatagtagaaagaatgtctttatagtcattgcctttctcatagcccttttcaatatttggcaaattttttaatattaattactatttttttcttgtttcagtaaacctacacacatattaaatttaacatgaaattacattaatcatgtgttctaaaattttctgcatcttaggatggttggccatcttaaacatcttgctggcctccagagagactgcccctcccagggctggccaattctggagacaacaaagaacttagccaggagcatgtgttttatgtgcaaactacccaatcccaagtctactcccagccacaaccctttatttaactcttacacaccactccaatatcccccctgccctaaatcctcccagggccacctaccagatgactagagatgacccctgtagaccagagctattgggagagggaaagagacagagagggagagagatagagtgtgtgtagtactatgaagctgagcttacccatattttaaaatttgtgagaatttagctatattttcaaagaaagaaaatgtgcaaaacaatgtaaataaatttaacctgtaaaattagtatttttgaataacccagtaaagaaaaggaaagattattaaaacatatttgcacagacctttaatgctttccaagccactgtttaaaagtcaaaagaggccaggcatggtggctcatgcctataatcccaggtgggtggatcacttggcatcaggagttcgagaccagccgggccaatatggtgaaactgcatctctactgaaaatacaaaaattagccgggcgtggtggcacacacctgtgatcctagctactcgggaggctgaggcaggagaactgcttgaacccgggaggcagaggttgcagtgagctaagattgggccactgcactccagcctgggtgacagagcaagactccatttcaaaaaaaaaaaaaaagtcaaaagaaactaaatgttattagtaaaggtcaaacctggaatagaaagtatagagaaagaaaagttggtgtgtgtgtatgtgtgtgtatgtgtatgtgttattttataaaggcttatcttcaaagaaactcaaatgaataactatgtaactctctctgtatgtaactgtaactttcacttgcaaaagtgtatcagtttgaacagttaaatcacacattcacctatctaagcatcacatgataagtaatgtttagataggtgaatgcataattttagtacagggaatttttagaatctttttagcacataattagataagcatgtatggaaagtatgttgttacaaagagtttactctgaaggacccatagtaagtcctctaaaccagtgcttaatctaattagttcttgtagctaatgacaaattacatagttttataaattaccagtggtcactaaaaattattactatcaccaagtctgttttcttgatttttcttataggttgattttagtgcatttgagctacaatcatattttattatctggaaaatgcctcgaagacatctgtggatctacaaacttccagggctactctctgcatacaaaggaggcatgaacaggcctttctactcagaagtggactaaggtgaatccatcagctgacatccgtcatagttctttgtgtaccaaacacctcatgtatgttgaaattagctgatttcatgattcaaaatagaccccatcttcagcctcaaggttgtccagtgcatccccagttcaacctcagaagaaccttttcagaagccaccagctcatgacacattccttctgggggtctctggtgggcacagaataagccccccttcccctcagggtctgcctgtctgccccttaacctgttctcctgctcctccattccaggttccctccacctaaggcaaactgcccggggcaactgcccagcatggaaagctttggtcttcacggtcttgactttttaccagcatctctgaagccccaaagtcacataagaatttatttgactgaaaattatttaagaactttatgtgttaattttccttataaagtgaaagttgatcactttcttttcccatatgtcctttgcccagacacaacttattgttactctgttttcaatatcgaagcaagaaatggaattcattgtgagcctgccccagtgctattcagactcattctatccagggagcaacttcactccataatttgtgtagatacagttacttacctacccactctctagtacataactccccatacacacccacggacttcttcccctagggaactagtcagtggtgtgtctccctttaccaggcaagtgcatgaaatcagtgcatgatgtgctggtcaatgtggtgatcttttcccctcttttaacctggggaagagagtttatggcagaaaccacagctttaatccacacatctttgtgtaccaacctcagtgttctacaaggcagagaagagaatgggtccagcgattcctcctgagcagttgtcacggaaatctcttgctctcctttgggaagatgagttttactctcaatgatgcattgatactcaccattattacaaggactagtgaacaagaacttgttatgtgccagcactgtgctatgcttcactcaagccagttaattcctgcactctcctgcattactgaatgatttttcttttcttctgaatggtagtttttaaatgtaggactactgtttcttcatcatttgagtttgggaattaggcctcaaatgaggcagcttatgaaatctgctttggaggtcaggggtcttctccatagtggaaaacatctacctgaccctttttaggccccaaactcctctccagggtgtagtgaatgcatggcactggcatccctcctgtaaatggaggggcttagatctctggaggaaacttctgggctagtatgtggctaccacgagaatggctacaagtgggaataaaagggctttgatcaccttagtcttgagttccaggcagtttttctgggccatgtcactgatcaagcatggtgacatcaaagtaaggtattttcctttttttttttttgaaatagtgtctcactctgtcgcccaggctggagtgcagtggtgcaatcatggatcactgcagcgtccgcctcctgggctcaagagatcctcccacctcagcctccagaggagctgggactgcaggtgcacaccattacacctggctaatttttgtattttttacagagatggggtttcaccatgttacccaggctggtctcaaactcctggcctcaagtgatccactcgccttggcctctgaaagtgctaggattacaggggtgagccactaagcccagcctggtatcttcttttgtacttttcagaagaactcaaaatggatgagtttgcataaaactgcatctgctgctctagtgccagtgaataggccatgaagcttctggctcagatgggactttagatctatgacctgctgggtattcagaaagcagccacagatagcataggagttcaagacaacaatggtgcgtgaaccaccatgggtcaagaggagccgttgatctgatctgatctccgctgtccccccatggctttcgtgcagacatagctggcagcctgatggcggtgctgtggaagcaggcccttcactggggtactggcagactggttgaagagtctacctacaggggagtgtcgagtccggctctccctatgggcaacaggcaagccacacagaggaccaactcttgaacaaacgttggtaacatttgtggtactgagggttgaaagctagggggattcttaaaactattaggagattctctcttgctagtgaaacagatgggaagcagaggaactactgcactttggacattgacttcagttttaatcacagactgttaaggctaggacatatttttctttaacttttagactcggggtgcatgcgcaggtttgttatataggaaaacttgtgtcacggggttttgttgtacagattatttcatcacccaggtactaagcctagtgctcaatagttattttttctgctcctctccctcttcccaccctcccacctcaagaaggccccagtgtctgttgtttgcctctttgtgtccatgtgttctcattatttagctcagacttataagtgagaacatggggtattaattttctgttcctgtgttagtttgctgaggataatggcctccagctccatccgtcttctggcaaaagacaagatcttgttcttttttatggctgcatagtactccatggtgtatatgcaccctattttctttattcaatgtttcattgatgggcatttaggttgattccatgtctttcctattgtgaagagtactgccatgaacattcatgtgcatgtgtctttatggtagaatgatttatattcctctaggtatatgcccagtaatgggattgctgggttgaatggcacttctcttttagctttttgaggaattgccacactgctttccacaatgcaatggttgaactaatttacactcccaccaacagtgtataaatgttcccttttctctgcaaccttgccagcatctgttgttttttgacttttttatagtagtcattctgactcatgtgaaatggtatctcattgcggttttgatatgcatttctctaatgatcagtgatgttgagctttctttcatatgtttgttggctgcatgaatgtcttcttttgagaagtgttttgttcatgtcctttacccactttttaatggggttgtttttttcttgtaaatttaagttccttgtcgactctggatgttagacctttgtcagatggatagcttgcaaaatttttctcccattctgtagattgtctgttcactctgatgatagtttgttttgctgcgcagaagctctttagtttaattagattctatttgtcaatttttgcttttgttgcaattgcttttggtgttttcgtcatgaaatctttgcctgtgcttacgtcctgaatagtattgcctagattttaagaaatatttaactcaaagcaacaatattaacagttcatttctcatctgaaacaatagaagaaaaaagacaatagatcaacctatgtttttgagatggagtcttgctctgtcgcccaggatggagttgcaatgacacgatctcagctcactgcaacctctgcctcctgggttcaagcgattctcctgcctcagcctcccgagtagttgggattacaggtgcatatcaccatgcccagctaatttttgtatttttgtagagatggggtttcaccatgttggccaggttagtctcgaactcctggcctcaagtgatccacccacctgggcctcccaaagtgctgggattagaggtgtgagccacctctaatcccagccacagactgaactctgagctttttttcttttttctttttttttttttttgagagggagtcttgctctgatgcccaggatggagtgcggtggtgccatcttagctcactgcaaactccacctcccaggttcaagcaattctcctgtctcagcctcctgaatagctgggattacaagagtctgccaccatgcccagctaatttttgtatttttagtagagatggggtttcactatgttggtcaggctggtcttgaactcctgaccttaagcaatccactggcctcggcctcccaaagtgctgggattacaggcatgtgccagcacacccggccagcttttttcatatgcttgttggccatgtgtatgtcttctttagaaaagtgtctgttcatgttctttacacactttttaatgtggtcgtttttttctttttaaagaccctggatattaggcctttgtcagatgcatagttgcaaatattttctcctattctttatgttgtctgtttattctgttgataattcttttgccgtacagagcctcttaagtttaattagatcccattggacattttggttagcaagaaaggacaatgcctagagcaataatcacaatgtaggacgtctttaaggaacaaaggtaaaagtttctggagattgaatgaccaattccactaaactgtcgcagcttgaaaattaccagaatgctctgtccatcaagtttagagaaatgcttcaagtttaggggaatgatttctattgtctatgaatacagctgaaaaaaaacaaaccccgtcaaaatatctctctcttttgggatggcagtgttcacaagcccctgttgcccagctacacaaaatagccagacatcatgcacctggtcccacaatgttgagatatgtagtgatttatgatcataataaattagtgtttcccaaaacttactctgtggaaccttgagtcaaataactttgggaactttgccaactgtatcttcttaattattgtgaaagttgtcagaatcaaaatggagtcatgaatgttaagaaaaccctgacaaatggagccaacaaaaaccataaagaaggggttctgacacttgtgtgctcgataatgaaaaagactatacaaaaaccacaacctggcacacaacccattgcaactgtacaaaaaatatatacaagaatatctgcccagcaactgcctgtccaaacttgtactggtgtcacccttgtcattgatctttgtaaccaaagataagtatttcaaaaacaattatgtagtcctcatttttttctttagaaatctttgccttcttttacctccctgacacatatattaatagtttgctatggcatgtatatgcccattgcaatgttctattccctaataaacatcttcttctagagagcctctctctgttatttaggttgaaaatattcttaagacatgtgagcctatttcatagctctgagaagttagatgataatgtgcctttacgtcttgtttagtcaataatttgcccaaattatttggtcttgaaatgttactttagcaagatacctattaacagtttgtataaatctgtctgatatagtgtagtagttattctttttttaattcatcacatctcttaatgctgatatgagagaaactttaagcggtaattttggtgcaaagatactgagcataatgctctaagacactgagaacacacaagaagcagcgaagtttgggaattggtaatatgaattgttagaagatcaatagactgtggaattctaggttgccctctggaatgtagactaacccactgaccatctggtaggttaggaggcagatgaaaccaagagtgtcctcctgggcctatgaaaataaggaacaagcagggattaggaaagatgaaaatgaggttcagaaggagtgagaaagcaggaaaggccaagagataattgactataaacaaagaagaaaatgtcagagttaaagatggtggaggtggagaaggtctaagcagtagatggcttcatctatttctgggtggatgaagtggaggggagatgaagattcttggcagctgtgacagcgtgcaaggagggtcttgaagaattagcagcaaggagagtagcaagcacaggctgaggaggtgcctgggactcaaatgatagggattttaaggaataataatcatgacacaatttatgccacacccctcagccctcaccactgcagtgcaccctagaagcccagaaagagcctgtccagatgcagggcaggctgaaactgctggggagctaactcccccaaaacattccccagcagcagcctggcttccttacatctcaggtagggcagctgtgagatgtgtgtttttcgctttttttaaaaaagagttttcttgaaggagaaaaccccaggtgcccacatagaatgtatgtgctgccctttaagtcctgctttccattccaggaccacttcttcccttccccaggaggtgtttccagccccttccacagaagctacttgtgttgttggtgggccagttcgggttcttgacttcgtggcacaacataatttgagagtgtgatcggcgcagtggctcatgcctgtaattccagcactttgtggggccaaggcaggaagattgcttgagcctaggagttcaagaccagcctgagtgagatcccatctctataaaaataaatgaataaaataaaaaagaaataaataaaaaaaattgagagtgacttcaatgtgaaagtaggtaaagaagtttattgcaaagtgaaagtaactctgatagctgggtgcatgagaaggagacagcgccatgtgacactgaagtactacccgttatgggagatgcgcatgattattcaaaggggtgagaagtggtgttgctgttgagcgtgttgcagatggtttcccaagtctgcatgtgcagtggccatacaggctactacatatattggatgtctcattagcattttaattctccacccaagggtgtgttttttactattataatgaacacaggtcagctcaaggacactaatgttgggtttctgtgttcatgcgaatttgtgaattttcccgtctgcccttctacctcctcactgcaggatgttctaaccatgagcccaggatgtggtttgtgcactgttaggcagtttgttctctccatcaatttggtaagtttgttcccacttaggcgaggctatgagcaacctatttaacctacctcacttgggtttgaattcttgtctcaatctgcatgtggggaacccaaactaattcacaaacatcatgtcatttggccatcaagacaactctaaaggatggcagaataatattatttccccttttattttattttattttattttattttattttatttattttattattattatttttgagatggcatctcactctgttgcccaggctggagtgcagtgatgccatctcggctcactgcaacctccacctcccaggttcaagtgattcgtgcctcagcctcccaagtagctgggactataggcgtgcgccaccacacccagctaatttttgtatttttagtagagatggggtcttaccatgttagccaggctcgtcttgaactcctgacctcaagtgatctgcctgcctcagcctaccaaagtgataggattacaggcgtgagccacagcactcggtctatttccccttttaaaaaggaaacaggttgtacctttttcaaagccacccacgtagaaagaagatgagccgagagatgaactagccttctgacttcatgctctgtgttctcatccctacatcctgaatccctatattcaagatgtgttactgtccacaaggttggtagattaccatgaggatggagagagggaagtatatattgatgtatgaatatcaataggtaaattatgagaatgtgatagggaaacaatgcccaagatgaaacatgggcattatgagtacaagggaagaaggtacagtgcaatggattaacctaaatcaaaggtggtccaggactattgaaaaccatgtgttaaccaaggtgataagtcaaaagggcaaaagaccaaagatagagataagtttattcattgtagaaagtggatttagggcagggcgcggtggctcacgcctataatctcagcgctttgggagaccgaggtgggcggataacctgaggtcgggagtttgtgaccagcctggccaacatggagaaaccctgtctctactaaaaatacaaaattagccgggcatggtggcgcatgcctgtaatcccagctactgcgaaggctgaggctggagagttgcttgaacccgggaggtggaggttgcagtgagctgagatggagccattgcgctccagcctgggcaacaagagtgaaactctgtctcaaaaaaaaaaaaaagaaagtggatttggtaggaaccaaaggatgtccgaaaatatctttttttattggtacataataactgtacacatatatggagtacatgtgatattttgatacatgcatacaatgtgtaatgaccaaatcaggacatttagaatatccatcatctcaaacatttatcttttctacatgttgggagcatttcaaatcctgtcttctaactattttgaaatatacaatatcttgttgttaactctagtcaccctgctctgctatggaaacttacttattccttctctctaactgtatgtttgcacacattcaccgaccctatactgcccactgtttccttctcaggcttggaatcttttgagatgtgctcatggtcattaataagacatttcaatattataggattacagaaaatagcattacaggccgggcatgatggctcacgcctgtaatcccagcactttgagaggccaagtcaggcggatcacctgagatcaggagtttgaggccagcctggccaacatggcgaaaccctgtctctagtaaaaatacaaaaattagctgaatgtagtggcaggcacctataatcccaactacttggaaggctgaggcagaagaattgtttgaacttgggaggcggaggttgcagtgagccgagattgtgccacttcattccagcctgagggaaagagtgaaactccatctcaaaaaaaaaagaaagaaagaaagaaagaaaatagcattacaaaactgaagagattacaatactggtctcaccatcatttttattactctactccctcctttcctagctgacactcgctccccatccatgtctattcatctaaaaatcctgatgtcccctggctgttggcctccaggctgctggatttggtcccttctatgacaactttactgacagacaccagccttctaactacacagaagtcctgctgcacttcataagatgatggagtgaatgtattcctgtagaacattatttgcacaggtaaccatggaaataatatttattttgtctaaattagtcacatgagggcaaaccgtttccttatctgcactctctttttctttttaaaatgagttcaaggcaatttagatgagtggggactaatgggaaggacctttgtgaaatcagaaagcttggatttctctcttcattttacctctgactgatcgtgacaccataagtaagacatataatagtttcattagaagaccctgttgagaaaggcaagagcagggagccatttagtgtgtgaggtacctgctggttgaaaaagttatggggctaaaaataatctcaacatgatgactctgttgaaattaggcacccaggcaaataagctggccattgaccaacccaggagactgccattttcccactgcctatgcaaagatcagacaggataaatagtcctggaaaaaccacagtcctggtgagggggtgagtgtggggggttgacaagtatatggtttcaaaatgaccataaagatggaagcatgatctataattctcatgatgcctcttaatgagtttgaatagagagcacataggtgaaaaaataaactatgcaaatataaagaggggtgactggttggaaacatgattggcaatgccaaatatggccaaagatttgaaagatgtagacaatcccaggtgaatgcttataatgttattcatatagtgctatattaattctaaatgtataggaagtataattattcattttcttcatatttttatcataggaagcttctagcagagaagttgaaagaattttacagtatatacctatatatgcacaacctagattttacaattaatattttactatagttactttattgcatggctatcagtctgtccatccctttctcatccatcaactcatcttggctttttattcatttcaaagtaaattgcagacatcagtacacttccccttataatcgatagtgtttcagttctttatttattttattttttgagatggagtcttacttgttgcccaggctggagtgcagtggcgtgatctcagctcactgtagcctccaccttctgggttcaagatcctcctgcctcagcctcctgaatagctgggattacaagcgcacgccactgtgcctggctaatttttgtattttttgtctcaaaaataataataataaggagtcagagacaattttaataaggattattaaatggaaaagtaatttattaccagatatttagagtcttcttccctccccttgtgtgcagtctcactgcatagcttattatctagaatatagtatgtgtactattaaatatctgttcaactgaatgtcagtaatctttggggtcttaacctgtttgggcagaaagacattagctggatgaccattccagattcttgactagcttggcattctgattttaacatttaactcaatttcacagtcatttgatcttttaaaaagtttagaatgttttcatgagcctgcctgcctggagggccctcttccccccagtgcagttcacaaaacatctgcgccaaagtgcttcgtgcatatggaattgactactactgcttcggggctgggacagggttgaatgcgatagccatcattttaacaaactgctacacaaaacagcactacaaagggagtattgattggatcctctatctgcctcccccagcactgctcaaagttgaatgtttccattgactttctaattgttccttcccccccaactttattctaaaggctaaactttagaataatactttaatactaaggaaaatttagtatagtctggacctgtcatgcatcctgttcaagggaaggaggggaagtaaatgggtggcaagtggaagaaggacaatctaattggacacttactagatgccagggattttcttttcttttcttttcttttttttttttttttttttttgtgacacagtctggctctgacgcccaggctggagttcagtggtgcaatctcggctcactacaacctccacctcctgggttcaagtgattctcctgcctcaacctcctgagtagctgggattacaggcatctaccacaaaccatacctggctaatttttgtatttttagtagagacaacgtttcaccatgttggccatgccggtcttgaactcctgacctcaagtgatttgcccgccacagcctcccaaagtgctgggattacaggtgtgaaccaccacacctggcctgggattttcatatattctgtattttatatactaaatatttatttaacactcattatgtgcagaaattttcatatactatatatagcatttgtctcattcgatctccagaggaacattgtcatcctaaaacccattttccacgcaaagtagaaactgatgttcaaataaatgaatttgaatttaaatctgagcttggttgacttcaaaaatccaagcagtctccattccctcaccctacctaaaggagttctgctaacaaaaggacctcgttttgtcaccgggggtcctggataccccaaaaagggctctttcctgttcagtgttgtgaagataatacaaaaagccgaaagtgtcaagcagtgcaggctttattctaaggccaaggaattggagaagtgggaccgtagcttgcaaatcaatttctcagtttctgagaaccaggaaattacaaattcagggtatcttcactgaaggggttgggcattaagagcaaggggaggaacattcatggtttttttgggaagcaatgaagattttcctagaacagggagctgccttttttgtcctttcttggtcttttctggttattgtcatagtgattgtcagctgtcatggtgctggtgggagtgtcacttagcatagaaattggattataatgaagctagaggttcttcagaggtcaagtaggcggccatactgggtttcaccagtttcagccagtttagttctaagaaggaactaatgaccacaggcatcctgcttcctaaaaataagcagagttaaagcccagtaggaatttagctatgtcatgtaggcattacattgggcaacaaaagcagagagggggcccagctaagccacctaggcactacaatgggtgacaattttatagtattatagaaaagattctctgtctgatttcttccacgtttacagaactccagatttactttcaggagtcaaagcaccggggaaagattcaacttccttcagagattttggaaacagagttaagggatcatttctcctgcctctcactcctacatcttctttcttagctgcctcctaactccattgggtataggagatctgggttagtgacaaaggatgaaaaatgaaaaaaggatgccaaacaatagcaattttcagggtagcaagaatgccattttggtaggcagcttctatgtctcctgtgcaatgattgctgctggccaggatcacccagccaggagggtaaattggcagtgtgtttctgcctcctgcccagaaggtgcccattgtcttcatgctggtccttggcaccctggaacatcccccatccctgcactgcagtgtcccaattcggcttactcagtgtggctggcacccatcatcccaaattatttctctctgctcagctacagaattatcatttctatttccaactagcaacagcttgtcacccatcagagatatatttccatctaaacaaagctcttatcctgccagtcctttgcataaaaatgttcagtgttttcctgttgtagttagaatgaacccaaactccttgccatggcctgtgaaacccgtgatctggcccagctctcctatttcatgtcctattactctactccttgctcgtgggacccagacaccattcttgcttttctaagacactccaaatgcatttttattctcatttgctgtaacctacttctttcccatcatgcagggtgcttgctcattcggaatctcagaggggtctctgttaacccttcaaccttgaatagcttcctccccacccacagaggcctctcttttatcatcaccttttctattttttcaaagagagtttcacagttagaaatcatgctttagatggatttgttcattttgttttctgactccactgaaatatctgctccatttgcaaggggccatctctacctgtttttcactatactccttgtgtgtagaacattgtgtactcaataaatgttgttcaaatgaaggcaatttatgagcactaagggttggctgaccatcatagcagaattctacctaccatggcaagcaggtaaaggaaaggttttgcatggaaatgggaggaaggaggtagggattaggtcctacactctccctaagattttcccacattattggcacacataagtcaaaaacaaatacaggcagtccttgttgtgcttggtttcagtaggcgtgaatatcagttaccatagttaagcttaataagccaggcttctaacaacacagttaaaatttcaattgttaccatgatacattaatttgtgagtaattttataaagtactgacatcactgccaggaatcagttcacagatcattaaatgaataacgtgctcatcctggtcagtgaccgatcacatcactcctcacctctctgccataagtgaaacccccctgtggaactatggtccctatagctctctcaggaacatcattcactgtggttcagcaggactgctgacattctcccagagtggactccaggccaagctttcatgaactttcctctattttttcagctgtgaagtagagagatgtagagatgtagaggttgaagacaggtgggctctgatgtgtgtgggcaaagcccttttcctttctgtaaccctaccctgagtgcaggtttatcaggatgttcagggtgctgacctgcttccaactcggacatgagtgatttgcgtcccagagcatcatgttgcaggcactgtgcctaatgctttgtattatttcatttaaccttacaacagttttatgcagtactgttataggactgacaggttcatatgcctgctgcacatgagcagatcaatacattgagacagcaggctttgcagcagagaacaagtttaatgactgcagggtactgagagaggagatgagaagagaccccgaaatccatcagaagttctgggctggggtttttaaggaaatcatggagggagagggactggagaattggagttgttgattggctgggggagggaaatgaaatcatcaggatgtggaaactgcattcgtgggcgagtcagcttcttgggtgcttctgaccatctgagtcaggagttgcattggtatgcagtacctgaaggaaaatctcaaagggaaaacttaacatttcataatgttcaagttgttacctatagagcagttaaaggcagctatgatcttgtgacagggtctgtgtgattctagggcaatgggcaccaaacagctatgaggaagggttcagagagcagctgacctcatgctgaatgctgatgtgctgcaagcttggcttattttcatttttcctttctttgctgattaattttataaagttcataaggatggcttcagtacaaactactgatatccccatttaaagatgaagaaaccaaggcttagaaaagttaaataatttaccagagactcatgctcttcttttgaagtaacaaatacaaatatttatgttttcacaaaaaattgtggaagactatttttataatgataacatgccctttgaaacgtgctacttttaaatctgagtcatcttactccctaaaaaccaacaagaaaagtggaaagcattgccatatatatatatatatataattttttttttttgagatggattctcactctgtcaccaggctggattgcagtggtgtgaccttggctcactgcaacctccgcctcctgggttcaagcgattctcttgcctcagcctcccaagtagctgggattacaggcacacgccaccactcctggctaatttttgtatttctagtaaagatggggtttcaccatgttggccaggttggtctcgaattcctgacctcatgatccacctgcctcggcctcccaaagtgctgggattagaggtgtgagccaccgcacccggccgcattgcccaatattttccagaggttttgtagatatggcatgaagccctctggcaatagttaaatgacatctttcgacaattctgtggccacaataggctgaacaccaaaactgatgctagatagattatgacaaagatgacttttttgtcaaaagctctttcctctcttttctgccatcacagtacagttggatgttgtctgattgttgtagtggtgttagtcatctgtttgtttgttttttttttttttttgagacagggtctcactctgttatctggctggagtgcagtggtgcagtcagagctaactgcaaccttgacctcgcaggctcaagtgatcctcccacctcagcttcccgagtagctgggactacaagcatgcaccaccatgcctggctaatttttgtattttttgtagagataaagtcttgctatgttgcaaggttggtcttgaactcctgggctcaagtgatcttcccatctcaacctcccatagtgctgggattacaggtgcaagccaccgcacctggccctagatgttacgtttttaaactcatctttttagtttcaattttttcgttgttgttattgtgatttgtttgtttttgagacagggtcttgctctgtcacccaggctggagtgcagtagcacaatcagagctcagtgcaacctcgaccttctgggctcaggcaagccccccacctcagtgtcccgagtagctgggactacaggtacacatcaccacacctggttaatttttaattttttttatacagacagtgtctccttatgttgcccagactggtcttgaaatcttgtagccaagtgatcatcccgctttggtctcccaaagtgttgggatcacagacatgagccaccgtgcctggccaaatgttttcatatttacagaaaagttgcaaagatagtacagagactttccttagatccgtcaacagctttccctaaagttaacaacatcttataccacacattctttattcatcagtatctactgagcacttagactcagcccttactatacatgaggcataatcctcaaaatcacactgcaaactctccgttttatatctgttccttggctctcactggtcgttttacttcagtacctggtctgtcttttaaattaagtagactctagggtaagttcttctggccttggaatcagaaggcttgaatttaagtcttgactctgccgtttgccaattgcttgacccatgttttttctgtaatactcaccctgtcaatctgggagagctggtttgagaatctgtcacgtgtcaactctgaaggaggatggccgtgtcaacctcatttctccctgtctccccagtgtcttgtcaaaagccagaacttagtaagcattcaacaggcagtgggtgcactggctgagtgattaaacaaggtaatgtttaaacaaggtaaaaaaggtaatacattaatattggcatgcaaatgttaggagttttaactgctcatataaaaactcacacgatctgcatgtgttgctggtgtcccctgtttggtgcccatgaatcacttcctgttttgttcatgatggagtctgaaccccttataagtgagtgcctgggaagtggtagacgtgatgaactgccttttcatcctattaagctatgtttaaaaaatgctaggcaaagtggtagcttattacttttgctaataaatattttctgatagtttatgagaactcgaaagccaatgttgctcttatttccgacttttacttactaaagtgctgatatccatttttgttatatattgttttcttgatttcattttgtgcagaaagtaaatgtgtataaatcatgcatctgcattttgttatttatttctggaaggtgaaaatatcttcatctaactcttggctttcacctgtaatgagttttgtgtttcattttgatttgattttctttcagttctgctacatcaatagacaaaacttgaaatactatatttaggatccctttgctggaagagaaaactaaacatttcatttagcgcttcagccccaggaggctgtataccatgtcactatttccatgctttgacagttgggtgcagttgtctcttgttattagtaaatttcatgaatttgctggttctggggaggaagcaaaaggtgtaaatatttgagtattccctgcatgtagcaatcccacagtgtcacatctgtctaatacctttatgagacagtccatttgcgtagagaataagtgtcctaggaaataaagctatcaggagtgtcgaattggaatataagaatgatattctgagcttaaaaaacatatataagactggagttcattgatatataaccttgaagagtgctctgaatgacaatcatgttgttatgctggtagagaattacgaagttttagaactggaagttctattttttttaacctcattttatgcatgaagaaatggagaccagaagggccaagagcctgtgaaattcaggcagccagcgagagactgagatcatgcagagataacaagctctggggtctgccacccagctttctcttgcgaagggatgcttttcagccattgttgattattcagcttgggggttattcagggttaccgcttttctgccttagtcttgcttctgcctctattttagcaaatctactaactgtacctggtagggctgtacctgagaggaggtgaatcctcagctagccaattttgtgttttagaggggatttggtaaagattcagtgtgaaggactttttttttttttttaaagataaaaaacttttttttttttggctgggcgcggtggctcacacctgtaatccctgcactttgggaggcagaagcaggtagatcacctgaggttaggagttcgagaccagcctggccaacatgatgaaaccccatctctactagacatacaaaatgttagccaggtgtggtggcaggcacctgtcattccagctacttgggaggctgaggcacgacaattgcttgaacccgggaggtggatgttgccgtgagctgagattgcgccactgcactctagcctgggtgacaaagtgagactccatctcaaaaaaacaaacaaacaaacaaacaaaaaatttaaagataaaaaactttttacaggattctgttgttttagtctatgactccatggtttcctcttaaggtgattaaaaacattttaattcaatggggcacagtggctcacatctttgggaggccgaggtgggagaatcacttgagctcaagagtttgaaacaagcctgggccacatagtgagacctcatttgtattttacaaacaaacaaaaaattaaaataaataaaaataaaacacttttaatgtatttgaataacccccaagctgaataatcaacaatggctgaaaagcatcccttcgcaagagaaagctgggtggcagatcccagagcttgtatctcttctttattatatcaacatatgtactttttgtgtgtgtgtgtgtgtgatgaagtcttgctctgtcgccaggctggagtgcagtggcgtgatctcggctcactgcaacctctgactccctggttcaagtaattctcctgcctcagcctcccaagtagctaggattacaggcacgtgccaccatgcccagctaatttttgtatttttttttttttttgagacggagtcttgcactgttgcccaggctggagtgcagtggtgcgatcttggctcactgcaagccccacctcccgggttcacgccattctcctgcctcagcctcccgagtagctgggactacaggcgcccaccaccacgcccggctaattttttgtacttttagtagagacggggtttcaccgtgttagccaggatgttctcaatctcctgccctcgtgatccgcccgccttggcctcccaaagtgctgggattacaggcgtgaaccactgagcccggcctaatttttgtatttttagtagagaaggggttttaccatgttggccaggatggtctcgatctccaggcctcgtgatctgcccgcttcagcctcccaaagtgctgggattataggcgtgagccagtgtgcctggctgacatacgaacatattaatatagaaatcttattctagaaaatactcttttaatgcgcttcgtcctatgaaataaagaaaaaataataataataataaagtactttgcagtctggtttggtagtctccctcatcccccaccccagtggccatccccatcccacgcagctggccaccactcctccttgaggccctttcttcacctggctttccaggacgtggtgccctccctcttctcacctctcctgctgttcttcatcgccccaaccttcgaccttgtctctctctacacccaggctcatggaataagacaccaaatacgtggtggtcactcccagatcttgattttcagctcagacctctcctttaacctctaaatcacatatgcaggtttctacgtaaaatctccaaaatagatccaaaccacactcttgaaattctccaaattcttccccatctagctattggcaacctgatctgccagttggctgagtcccaaattccacgttatccttgattcttttcttttactctcacgccccgaatttaataatcaggatgttgtcttgcctctaccttcaacatatccataatttgacgacttcttacccctgcactcctatgttctaaggagcgaagtactgtgttctaagccaccgtcatgtcttaggttatttcaacctctctgactgttggctctgttgccccacccctgcctccacagtctacacagcaacctcagcgacttttgacaactgacttctagtcatgtcgcttctcttctcaaacccagcaacatgccacctcctgttcctagtttccctctcctggccgccttggtgctccctgacctctggccatattttctctgggtgccatggcacagctcctgctctgcagccaggattgcttttccctggtgtgtcctcatgaagctctcactcagggcttctcagtgttcattcagagggcactttggcatctaaacccttctcagaccatcccggctgaagttgcagctcatatggcccgtggcactggctcttccttagttcatttcccccgccaagcatttagctttatctcatagcacactgtttattttatccattttatgtcatccatcttcatatttattacctgttcttctgctagaaagtaagcccctctggggcagggattcttgccttttttgttctctgtttcaggctccatctctagagcagttcctgccacccagcagacacaggattgtttgttaatggatgtgggaatggatgttgggccttataaacttgatgagaatcctgcttatgtaactcaaggaaggtaattgcacccttgggaccaagtttgttaatttgtaaaatagaaacaataagagtcctcacagtcttgtatgttgttttgagggacagattatattgctgtatataaaatgcatagtattaagttcttcacacactatagttgtatttttgtttttttttttaatttttttgagacggagtttcactcttgttgcccaggctggagtgcaatggcatgatctcggctcactgaaacctccacctcccgagttcaagcaattctcctgcctcagcctcccaagtagctgggattacaggtgcccaccaccatgctcagctaatttttttctatttttaatagagacagggtttcaccaagttggtcaggctggtctcaaacacctgacctcaagtgatctgcccgcttcggcctcccaaagtgttgggactacaggcatgagccaccacgcctggctatagttgtattttaaaaatttatttatttatttattttggagctagggtcttgctctgtcgcccaggctggagtgctgtggtgtgatcatagctcacagcagctttcacttcctgggctcaagcaatcctcctcttgaatcttctttcaagagcattttttatatttatgcagaaaaatattaatacattttttattccctggctgttaagagaattgactataattaaacgaccaagatcttataattatattatcttagtatttataattgatcttagtattgtaatatattagtataatataatattaagatctcagtagttataattgtagttgaaatacctcaagttatttttcctaaaagttctattcaaaaacattttaatacatttataagttttgtttttctagaaattgttagcacactttttggtgtcattattcatagttaagaagtgtactatttggtatctaaaaacgtcacggttgctttgggctaggtacattttcaatgtccttttatagccattataaaggtaatttttagagaattaattgctttttgatgtttaacattacgtggaaaaaagtaaacatcattaattctaggtatttttccctcgggtgccaagatttcatcatagctttaaataaatttaaattttaaattttaaattaaaataaactactaatttaaaataaattactaatttaaaataaatactaataaattttaaaaataaattactaataatttgctaaatggtatacatgtaatttaatattttaattggcagttagtaaaatattgacattaatgccactactcatattcattttagctcaaatttttaaagaatgactgcgaataataatacaggtgttttggggcatagtgttgtaatagtgcataggtccaaaatatattgctcaacttttcaaataatttgccttgttcatatttttgtatgattttggcttatactgcaaacactgtgtctcaagctaaaggcagatttcccctgaacctctcgttttcctgaactccaccaagagcatcatcacaactgctttccagggtgatctcctgggggcaatcatcctcaagaagattgatatttatcctccaaatatctgtcacatttattcctattaccttagattaatacaagttgtcatttcccataaaaactagtttgaagatgagtctctaggccgggcatggtggctcacgcctgtaatcctagcactttgggaggcttaggtgggcggatctcctgaggtcaggagttcgaaaccatcctggccaacatggtgtaaccctgtctctactaaaaatacaaaaaaattagctgggtggtgtgcacctgtaatcccagctactcaggaggcagagacaggagaatcacttgaacccaggaggcagaggttgcagtgagccaagatcgcaccactgcactccagcctgggcgacagagtgagactctgactcaaaaaaaaaaaaaaaaaaaagatgatgagcctctagctttgaccccttgtagttctacccaccatccagccagtgatctgtgtgtttcagactagtcagattctctgttgctggcctcctccaggctacctccttagcatagcgtgtaccatctgatgtccaatcctgctggatgtggagccaagggaaagggccttgtccagtgcggagaaatctccctgggccatccctagggggcaccatgcagtcagtaagaaagcaattattcacaaaggacaagtgacctggaaaaggtgtgtcaggtggagggtggggctgtacaaaccagacaggatgaatgaaaaagcaaagatggtactataaatcaggaggcaggaaggggggactcctaatgacatgcaggtcccttagcaatttcctttcttggaggaaatgttaaatttataatgagggaaagggctgcacagagatcgtgttcctctttctgtctagacaaatgaggtaactgtcctccctgcagcctaggtaccagctttccagcgctacttatttttattttttatttttttttatgacggagtctcgctgtgtcgcccagtctggagtgcagtggtgggatctcagctcactgtaatcttcatgtcccaggttcaagcgattctcctgcttcagcctcccaagtagctgggattacaggcacacatcaccacggccagctaagttttgtaattttagtagagacagggtttcaccatgttggccaagctggtcttgaactcctgacctcatgatccacctaccttggcctcccaaagtgctagggttacaggcctgagccactatgcctggactccagcgctacttataaataccaaacccaacctgaacagacctccacctttttgtgaggtgtttcctctgcgtggaagtcctttactcaggcttgcagagttactccctactgaccaaggttcaaggctaatactttctgtgaaggcctttctgcacctctccctcaatcctttatttttcaaatagattaatcacccattctcctgtgaatgaggtcacatctttgccataggcctgttctatgattcttcaccttgcattctactgactctactgacagtcttgaaactgtccctgtaaattttataaaattaatccaggaagaagggagaggagaaatgaaaataaacccagtttgcaatacatcagcatgcatcatgaggttgactgctctaataccttttcctgatagctgtttgctgcccattgccgcagaatcatgcagtccctgtcacaaggttatagttcctgttaactgctttatagataacaacttaagcactgtgatttgagatattccttcaggtccagcatatccatgaaactaccgtaccaggtggtctgaaaaaccccacgaggagctgactcatcaaagaatgtggtttccacatcctgatgatttcatcccccttactctgaccaatcaatgaccctcaacctccatgatccctgtaaaaaccccagcccagaactcctggggagatgacttgagggttcctgatgtttcctctctcagctgccctgcaatcattaaactctttctctgctgccaacctgctgtctcagtgtgttgatctcttactgtgcagtgcacctacaagcccagtgatcctgtaataggctcgctgcgttactcagtgacatcctggagggcttttcctctcttatttcctttcacagtgtctggtacatggtaagctctcaaagatatttccagtgcattaaaagtaaaatataaccttaattcttttcatgtgaagagatgatagagaagagaagaaaataatcacttcccaagacttttgttaaaaacatgtaaatttatcttatacttaaaaatattttattttagatggttcactttctttcccttgctttttggtattttattttgtgattttgaatattattgtaatatgaaatgatcagcctaaagtgatcaaggttttatattggcaaaaagacatcagatttagtttagcaaatatgtagcatttacagtattcaaaactctaatcacaagggtgagatgggatggggtggaggtgacagttactatagagaagtacactgtatgaaaactggccctgaattatttggaaaatttgatgagtttccatgtaattgtgcttctagctgacaatgtgaagtttcaactgttttagtgtgggaggtggtgacttgctcatccctctgcctctgttttttgaattagtcctttagtcatctaagcataaagcaaattcttggaactaactgtccggtcaagatcactcatcagaatctgcattctgtcaggtaatataaatagtgtgtgattgagtgaggagagctttgttgtgcactctgctgccctttgtggagtagagatatttctgatttcatatgtgcaggctgtattttatactgaataacccagattttacacaatgtgcaatggaaacagagcagagaatctgagagggtcgtctgacttaaaattagatttgttagtgagttttctttttttgaaaacgtaccttctgaaaataagaagtgataatttaagtctttccaaaatggtgtaccctatatataacctctaagagattcctgtataaataaactcaaaacatactgtctacattctactctgcttagaaaattaggtcatgagtacaccattgtgttacgttccacctacaaatattctcactacttctctgagtgatattccttttctttctcttttaattatgaagaaaataaatatctgagcatttgtagcaatatgaaagcatatacagtcaaatttactttttgatctttttcctttcttccctctcattccagaacgctagaggtgactcttcagaggtgacctctattttcagtgggtgtgcatcttcctaaaatccttatgtgtcttagtttgctagggctgcaataacaaaatatcccaggctggctggcgtaaacagccaaactttctcaccatcctgaaagttcaatgtgagggtgtcacagattcaatttatcttaaggcctctctgcttggcttgcaggtgttcttttctctgtaagcactcatctccagtgcctctgtggcctctgtgtgtctacatttcctctttgtaatgagcacactggtaagatgggattagggcccaccctaacagcttcatttaaacttaattacctgcaaatcagtcacctcttgaggtcctggggttagggcctcaacatatgaactttggggaggcacattccgcccacattgcatagatgcagtatcttttgccaacacaggcaggagttcagtacactttttttcttcctgtgatttgttttctgcttaacgatgtaacataaagatgtgattgcagtattccctaatatggataatctgtatttatgacagtattgatgaacatttaggttgcttccaattacttgctgtcatatacactatcgcattaaatatccttggaatcatatctatttaacttatgtgattatttctttaaggatagatggatagaaatagaatttctaggttaatgtgtaggtcatttatatgttgtaataatactgcgaaattgtattctcaaaaggttaaattaatttgtacctgcccaaaaacttcattactgttagctattaccaaatttcaatattatcaatttttaaaaaatttataaagaaaagagatttcggctgggtgtgttggctcacacctgtaatctcagcactttgggaggctgagcagatggatcacttgaggtcgggagtatgacaccagcctggccaatattctgaaaccccgtctctactaaacatacaaaaaaaaattagctggacgtggtggcacatgcctgtaatcccagctactgggggaggcagaggcatgagaattacttgaacctgggaggtggaggttgcagtgagctgagattatgccactgcactccagcctgggtgacagagtgaggctccatctcaaaaaaaaaaaaaaggaaaagaaaagaagtttaaatgactcatggttctgaaggctatacaggaagtatagcactggcatctgtttctggggaggtctctggaagcttcctgctcagaaggccaagcaggagcttacatgtcacatggcgggagcgggaggaagagagcaatagtatcagtatattaaaacaatttgtgtatctgatgggcaaaactcactattttaatatacatttttcttgtaagcagagagtctgaatatcttttttatatgtgccatgtgtaatttagttgctgtgtgtctaaattgtctgtttatattagatacccattttttattgggctgttggtcttttggttattcataataattctttatatattctgactatttgtactttatctgttttacattttaaaatatttatattagatgtgacttatagcttaaccttgtttttgggttttttcgacctagagagattttacatttttatatgatctaatctgtcagtattttccttttaaagatttgtgtgtttgggtatgtcatgtctactaacagacaatggtaccattttcctgtaagttctttggtatgaattaattaaacgtatttctcttttttaccatgtcataggtttagactataccgaagaacttgcagtgaaacatgaaggtctactttccttgtccaacccctcactgcacacacactcctaccttgcctgcctgggcaaccacattcactgcttagcactcagcattctagctctttctctacgcatttacacacgtctgtagatctcattataaagccataaatgatatccaagtacaggtttgcttattttgcttgctttttccatgcaacaggatgtctttgaaactttaaatgtcagtacaaataagtctgccttattctttttactttcttggaaatgtaaaatgtcagtacagataagtctgccttactccttttagtggctaaatggtattgcatagtgtttatcctataatttatttaagtacttctaccatgatcaatatgcagtcatttttaaattgttttgctattaccaaaatttcagaaagtggaattattagttttattttctaaggtttagtctaattttcatctgcttgatagttctttttgtattcagtatgagagttaggagataaggctgtcagccatacattgagcagcccatttttatcaaatttaaactgatattttcttatattaaaaaaattattatgcctaattaattctgcttcttgactcattgttcttatttttcctattgttatgtcaagaccacagttttaattaccaaaaaatgataaaatgctttatctgcttgagcaagttaatctatattatatttttttctaaaagtatttaggtaatttttattatttatttcctaaatggggtagagatagcttgtcaaaatatggaatatttaaaggttattttatactaatagattaatttgggggatattgaccttttagagtattaagtctcccacaataactatgtcatgtctctccttttttttctgtttttctctgatgcatatttttctttccatttaccttcgtatctataccatcattttgatattataaatgggatcttttcctttttacttttttttggggggatggtacagagtctcactctgttgccaggctggagtggagtggcgcagtctcagttcactgcagcctccacctcctgggttcaagcaattctcctgcctcagcctcccaaatagctgggattacaggagtgtgccaccatgcccagctaatttttgtatttttagtagagacgaggtttcaccatgttggccaggctggtctcaagctcctggcctcaagcaatccacctgccttggcctcccaaagtgctgggattacaggcatgagtcacctctcttggccattcttattaaattttataatttgttattgctgctatatcagaaagttattttctttgcatatttatcttgcatcattaaaaaccagtcttgtctctaagaacttaaaaatttatgaaaaaatataaagttaatattcaaattagaatataggaataattagggtgtaattctgtgacctattgtgtaaattaccttcagggttctaaaaggttcaaatacacttataatgaccataaggagcttaatggaggagcaactcaacctgatcctttaggaaaaggcagctccctaagcaatggattacagtgaacaatggcatgaagatgagatttagtatggtatatgcttaaaacagtgattagcgtttcttggcagatcagagagggaagctaaaatccagtgagaataatggatagaagggtagggtggcagttgtgaagactcttcaaagtcaagtggagtagtttggaattaattcgataagtaagggaattcatcctggggtcagagaagtgccatccagacagtagaactgtagaattatttctggcacatcgaatgcagttggaaccagggtgaacttgctaggaagctattcgaatcatacaatctgacagagaaaagggcctgaaacaaggataatggtaaataaatgatgcatttccaaaaaggaaaaaatcagatgaaaaaactgaatatgaaagaagaataaaatacttaaaatatttttattttagtagactagattaagagtagtactgttgtaggagacagaggactagagagactgatatggggaacaggaggatttatttgggtgtacaccagatcagtggattcatatctgaaaagctgagcattgaacaaagactgagtggggtttttataagcaaatttacagaagcagaacaaaagcaatcaatcatacagtgacagatcatgtaatctatagcataactgttgccttagcataacttgtggccttgcatagctagtggacttgcagttgcatcaaaataaaaacagaaactggctaaatacagacatttgtaaaacgcggtcataattattagttcagagaaggagagacagtaaaggaatttgtttttcttttcaactttgctccagagggggctgtctggagaatattcctttggcctcagcttttcagatagtgttatcttataactgtccttgaagtgaactggctaagtagaggaaaacttgtgtttctcacttaacccttgctttattctgtttctctcttttaatttctgcatcaatatgattgccaaagaggatggaaagctgttttagtgagaaataaaaataagtttgggtcagaacatatttagataagcgttggaataatagaatgtatatttgatagaaaactgaatctgggtgatggaattgctgaaagagctcagcagcatagactgcttctttcttggggcaagtcgtcttctgccaatctgcttttgatttgtggtatggttagacttgtcattgttgggtttctattgatgttaaaggggctttgttgtttcttttgttttggtagaaagtaattaaaccagtgaaaaatgattagctggaatttttttttcacagagaatatgattttctaaaaagtacaattatgctcaagttaagctttttataaaaggtatttggtgttctataaagggtaaagacattagactttttttaaacttaaaggtcacatttaaaggggaaaaggtgggaacatgagcaatgcttgcaagaaccacagcaaaggaattattatttttaaatttttttttttatttgagacagggtcttgctctgtcacccaggctggagtgtagtggcatgatcttggctcactgcagacttgacctcctgggctcaagcaattcttcagccactcacgtagctgggactacaggcatgtgccaccatgtccaggtaatttttaaaaaaaatttctgtagagatgggctgtcactatgttgcccagactggtcttgaacttctgggctaaagaagttctgccttggcctcccaaagtgctaggattaaaggtgtaagccaccatgcctggcctacagcaaaggaattatttctgttgatggatagtacaaatttttagcctatagaaattcacaaaatacatgttatctatatatatcataaactgcttctttattttaattggtaaacaagtattgactattaaatattgaaagcagtgagaacatttcagtttcctaaaactaacccacaaggctcaaaacttaagaagaaatatttgacaaaaaattacactaaatttatggaattctagagtgtatctttttcatatattaaatcttgtggaaaaaaccaaagtagcagttatagatataggtgttggtaatatagatgcatcttagacaccctcgtgttaagctcctgattcttcaaaacatattcattttatgttccttggaatattataaaggctggtcagaaaactaacagcatttcaaggatacagaaattcccagtagggacacacatttatttgatagttgattctaattactaaatgacaaaaatagttgaaaaaatatagattacatataagcttgattaagaactgccatcaactttttagacttttttgatgtacaattctatagttttaacacaggtatatattcacatagccaccaccattatcaggatacagaattgtttcttcactaaaaagctccctcaggctgcctgttctcatcaccctccccagacctcctaagcatttgcagtcacttatcatactttaccactatgattacgtctttttgagaatgtcatacaaatagaatcatgtagtttataactttcgtgaccagttctttcactcagcataatgcctttgagattcatccacattgtgtatatcaattcctcattcctttttgttgctgtagtattattccataccactgtttggccattcacccactaaaggacatttagattgcttccagcttttggcaattatgaatagagcagctataaacatttatgcaaaagtatttatgtgaacataatttataattagggtaaatacctaggagtacaattgttgggtcatatggcaaagtgtatgttaaatttattaagaaactgccacactattttccaaagtggctgtgccattttgcattgccaccaggaatataggagagttccagtagctcaatgtgcttgtcagcacttggtatggccagtgtattttattttagccattttaatagatgtgacgctcattgtggttttaatttgcatttccctaatggtaaataatgtttacaacatttaataatgttggacatcctaatgggtgtgaggtgatatcttattctggtgttgatttgcatttctctagtgattagcaatttgagcaacttttcatgatcttattggtcatttgtatatcttctttggagaaatagctactcaagttctttgagcattgttttaattaggccatttcatatttttgttgttgagttatatgagctttttatgtatgttgaacattaactacttatcagatatatgatttcacatattttcttgcactttattggtgctttttcactatgttgattgtgtcctttgaaacacagatgttttagattttgatatagcacagtttttctgtttttacttttttctttgcttttggtgtcaaatacaagaaattattgccaaatttaatgttatgaaccctttcccttatgttttctcccaaggcttttattgtttttgctctaacttttagttctttgacccactttgagttaattttcttatatggtattaggtgagggttcaacttcatttttttatatggttatctggttttcccagcaccatgtgttgaaaaaactgtcttttccccattgaatggtcttggcacccttgtcaaaaattcactggctagccaggcatggtggctcatgcctgtgatcacagcagtttgggaggctgagataggaggactgcttgacccctggagtttgagaccagcctgggcaacatagtgagaccctgtctctatacaaaaataagaaattatacaggcatagtggtgcatgcctggggtcccagctactcaggaaactaaggtggacagattgcttcagcctgggaagttgaggctgcagtgagctgtgatcatgtcactgcactctggcctgagcaacagagtgaggccttttctaaaaaaaaccaaaaatttattggccatatatgtgagagtttgtttctgtgatccccattctattttattgatctctatgcctgtcattatgccagtaccacactattttgagtgctgtagctttgtagtaaatcttgaaatcagaaaatatatgtcttcttactttgttcttttaatgactcttttgcctattttgggtctacatgaattttaggatttttcttcctatttcttagtaaaagtaattgagattttgatagagatggcattggatttctagactgcttcaagtagtattgtcatcttagcaatattaagtcttccaatcaatgaacataagatgtctttctacttatttaagtgttttaaaatttcttttagtactgttttatagttctcagtgtataactattttgcctccttggtaaaatttattcctaagtattttattctttttgatgctatggtaaataaaattggtttcttaatttctttttaaaattattcattgctgctatatagaaatgcaactgattagtgtgtgttgattttgtattctgcaactgtgatagattcctctgttacctgtaacctctcgttttttaaattagtgtgttcagaccatatatgtttggatttaggtctatcattttattattactttttctgtctgttccttctattttccccccatttagcatttcctgccttatttggagttatttgaatatttgttagtattcattttaagttatgtattgtgttttttactacatattttcataatttatttttaatggttggtttagggattacaatgtacttatttagtttttcacagtctacttagaaacaatattttaccactctaagtgaaatacagaaactttatcaccatataagtctctttactccctcccatttatgttgtggttatcttgtgtactacatctgtatacactgaaaactccaagaacaatgttatgatttttgttttctactgtcagacatatttttaaagagtctagagagaggagtagcatattacatttgcccagatattttctatttctgctgcttttcctttattcttgatgatccaagtttcctttggtactttatcttttctgtctgaagaactgcttttacaaattttttcacagtagttctgctggctgtgacttaccagctttcctttatctgagaatgtctttatttcatttttattcctgaaggaaattttcattagctataggtatctgaggtgacgtttcttttcttttctttttctttttctttttttttttttttttgagacagggtcttactctgttggccaggctggagtgcagtggtgtgatctaagctcactgcagcctccacctcccaggttcaagcaattttccttcctcagcctcccgagtagctgggattacaggtgcccaccaccacacctggctaattttgtattttttggagagacaagatttcaccatgttggccaggctggccttgaattcctggcctcaggtcatctgcccacctcagcctccccaagtgttgggattagaggtgtgaactgctgtgcttggccttgaggtgacagttcttttctttcagcatttaaaaaatgtatttctgcttccttatggcttttatggtttccgatgggaaaactcatgaccaattcaaattatttccctataattaatgtgccattttcctctgattgttttcaggatttttattttttttgtgtttagttatttgagttgatttttatatgtctcagtaggaatttctttggatttattctgttggaggtttgatgaaatttttgaatctataggtttctgcctttcaccagacctgagaagttttcttctattatatcttcaaataatttttttctgcaccacactcttttttctctccttcttaagcactggtgacatgattattataaatttattcttgtttcacaggtccatgagactgtaaatttttctttattctgtttttaagattagataatttctttttttttgtttttgagatggagtctcactatgttgcccaggctgaagtgcagtggtgtgatctcagttcactgcaagctccgcctcctgggttcacaccattctcctgcctcagcttccggagtagctgggactactggcacctgtcaccatgcctggctaatttttttgtatttttttagtagagacagggtttccctgtgttagccaggatggtctcgatctcctgacctcatgatccgcccgcctcggcctcccaaactgctgggattacaggcgtgagccactgcacctggccaagattagataatttccattgatctaactttaaatccactgactcctctttctattttattgaggcagtgttgctatttcttgtttgtcaatgtatttttcagttttaaactcttaatttagttctatatatcttctgtttctttgggagagactgtatatctttttatttgttgaaagagtgtttgcccttactttttgttacatcatcacgatagctgctttgaagtctttgtcacataatgtctacatgtgtgatatctcagtgttggtacatgtttaatgtcttttttccacgcaagctgagatttttttagtttttcatatgctaaggacattttaaacattatgagatttcgggttttgtaatctatgtaatattaatatttttgttttagccagcaattgacttggttggatgcatgtagatggttttcaccagccttgtgtgggttttggttttaatgccagttctgcttttgaggatttttcagtgctatgtagatctttcctgtgtgtgcatgacccagtagccagtctgggaggtgattatggtccatccaataggtcaattcttaaagtctttggtgtgctgtttagggtcagatatatgcatgcatattttgggcatgagcccagaagttcatagacaacttgatgggatttctatcccatgtgcctcttttttcataatctccttagaatcttccagttccttggtgttctcctttaggtcatcttgctagaaaactttggctctacttatcccctgtgttgcatacttccagccacttccatccacgatgccttcattcagggtcaagtagtagaagagagagaaaaatggaatatgctttccattcctaattaattatcttgattagagataagtttcccatctttcagaattttagttatctgtaagcccctgttgctgccactatcactaacaccaccactatgggatttcctgtggacagggacatgagagaatggagaaaagatgtaaaaaacagatatttttccccatgtgtgtaagtattagaatttctctttcccactccttgaaccagggctagagggattctcatgaagttctctgtgtctcatccagtgtccttttctcattttggggccaccttgagtctaggagagggtatactggagggaaaataagaaactagtcactagtttgcattagggaagaaagaatgaaatgggctttttctctcttacctggaactagaaccatcttgtttcaatgttttatactgtttgtttgataaacatcaatttattttacattatttgataaacacgattgtttcatcatggcttgcttaaaagaatgcatgatcaagaaagtttcccatggctgggtgcagtggctcatatctgtaatcctagcacttttaagaccagcctggccaacgtggtgaaaccttgtctctactaaaaatacaaaaactatccaggcatggtggcacacgcctgtaatctcagctacttgggaggctgagataggagaatcacttgaacccgggaggtggaggttgcagtgagccaagatcataccactgcactccaatctgggcaacagagcaagactctgtcacacacacacacacacacacacacacacacacacacacacagagtttcccataaaacatttataaattagaaattaaacttatttaaaaataatgaaaattatttttaaattatacagttgatatagcaatagtttgctttgctatagttaattaggatggataaatctaaaaaatttctctgaccaaagcgtcccatctatctcccttccccttctgttatggagtgaatgtttgtgtttcctctctcccccaactgcccaaattcatatgttgaaatcctaaccctaaatatgtgatggttttaggaggtacgtcttttgggaggtgattaggtcatgagggtgataatgcccttatgaaaaggaacccagagagctctcttccttttttttttttttctcggtcatgggaggatacaaagagaagtcaaaagtctttaacccagaagagggtcctcatcagaacccaacaatgctggcaccctgatctgggacttccagccttgagaactgtgagaagtaaacttctgttatttacaagccacctcatctatggtactctgttatatcagcctggacagactgaagcaccttctcagaggttactgctccaaacattgtctctcaacatgtctcagaggtctagccatataattcagatagagctattgtacttttaactgattcgtttatagttttaatttaacttagtgtattaagccattctcctatttagatatttagattttttcaatgaaaacctgaatgcttacttagaaagaatagtagcatctgtattataaataattccagagctggcagtctcatatagcctggtgctgtgagttttaaaggtgtttgttgaaatttttgatctggttggacctcacattttttgtttttctgtgttgagccacagtcacaacactattaagccatgtgtcaagtccctttactgaaaagcaatatggtaaattgaatgccagtgaaaatcatttttaattgaatttctatagttttcccaagagtataatgaatataattggctaagtccgcagccacaaaacaaaacaaaacaaaacaaaacaccagtgtagaataatgcagcttttcctctaacagtattttctatacaaaatggcttttttgccatactatcaatctttttttttttttaaatcatggctctacttcttggtttgttgagaatgaattttacgtaggctatgatgttggtattctctagaatttcatgcatggagtacctaacacatttagaaaccattcacaaattggatggcatgtggcggattgaaccctgagcttgtctctagcccttctctaaagcccactggaatgacagtaaaggaacaaaaataatataatccatgaggacaaagagacaagagaagtgacagcagcagaccagagacatcgaagatgtttggaagagcaaatgaaagaatggcaattacttagcagctgaaagccacagtggaattgtgtatatatctctatacagagaaaaaagcatggatttttgtcacagaaccccagaaaatttcaggtgataagagcaccatggaagagcaggtaggacagaaaatctttaacatgagaataacctccacgcaccccccaacccccgccccctgccttcctaagctcacatgaacggacgctccctcctccatcaaagaatactgtagggtcattctctggaaatactgaatgagaaagctcaagcctcaggatgccacacagagctggggcttcagggagatgccgtgctggggagagggaagggaagcctgcatgctgcaggaggagtgtccccggacagcggccccgcacatctcctgggatgccatcgcccaggttcatgctctctgagcatgaaatcacccaactattctctggagaaaatgattggtcccctaaaaaagcttctcagattctgacaagaaggactttccaatggaatgacaaagtcccaacccagtccctcgaaataaagctcaaaggtcagtgtgtgtgcccaagcactcagaattcactcattttcttagtgtcttgttcttaaataggaccatcagcaaagacgcccaacacatttgaggaaaatcttcaacatgaaagtagagaacccccaaaacaaacaccaagagaggacaatgacaaaaatgcagagagcagaagaaacttcaagaaaatatataaaaatgtctgcagagagatttgatatcacctatatgaaacaagaacaggggttataaaaggaaggagaaggagtgctcagaataattaaatataatgttataaataataaaaaaaagtgttgggacagatttaaagattcttacaggatatttaaaaaaccaaaaaactggatgggcatggtggctcacacttgtaatcccagctctttgggaggccgaggtgggcggatcacttgaggtctggagttcaagaccagcttagccaacatggtgaaaccctgtctctaccaaaaatacaaaaattagcctggtgtagtggcacatgcctgtcatcccagctactcaggaggctgaggcaggacaatcacttgagcccaggaggcagaggttgcagtgagccgagatcatgccactgtactccagcctgggcgatagagcaagactccatctcaaataaataaataaataaaaataaaaaataaaaaaccaaagagacaaaaaataggagaagaagaaaattaggtgatttataagatgtttaatgtacttaaaaagattttcagatagaacaaacaaggaaaacaaaaagaatgatattatttttaaaaatcaaaagaaaataaaagaaataaattcatcaaactagggaactggatgtgtgtggaagtcctgagtccagaaaaacagaatttttctttcctcaactattgactcattatctaccaggggaagggcctgggtgtgcctggtcaggcgtctctcgctgctccagctcagcacaaggagcagggcagggaggttgtgtgccacttgctctagacagcatggctctgtggaataagtgggaagttaaggtaaacctggagaaggaaatactgaagaaggatgtgaacagagagactgatgtgtggaatttcagggagtcataattagtaataatcagtcatgaaatcagaggaccacctaaaatgactattctgcttgaccatcacaccagctctttggctgataatagcaggcaaatgtaaacataaattaggaaaaaatttcaacatacaccatttcctaactaggaagtggtgcaacagggaacagcacttgttatttgcaggacagtggctggggcgtgtgtgtgtgtgtgtgtgtgtgtcaggagctaacaggcatgcaatgtgggcagaaccaaattgaagaaaagccagcagatttttgttcccagatctgagttttgggagcacagcaggtagcagaagccatcaggataaggaaaggccgagtctctggcacatccggctgcatctttctctgttcctgtccccagacgggcaagtactgcctgggaaaatcagccagcaaaactagagccaagatggtggcagtgcctcagtattttcagaggctttaatgctttctctgtttccctactcagggttctctcttatggccttcacaagtagctattttatatttattgcatactctgacacctgctttttttttttttttttttttttttttttgatggagtctcgctctgtcgcccaggctggaatgaactggtgcgatctcggctcactgcaacctccatctcccaggttccagcgatcctcctgcctcaggctcccgagtagctgggattacaggcacacgccaccacacacagctaattttttttttttttttggagacaaagtctcactctgacgcccaggtggagtgtagtggcgtgatctcggctcactgcaacctccgcctcctgggttcaagcaattctcctgccttagcctcccaagtagctgggactacaggcacatgcagccacgcccggctaatattttttgtatttttagtagagacggggtttcaccatgttgcccaggctggcttcgaactcctgagctcaggcaaactgcctgccttggcctcccaaagtgctaggattacaggtgtgaaccaccgcgcctggtctcattttttattagtagtagagatggggtttcaccatgttggccaggctggtgttgaactcttgacctcataacacctgctgtttactaaatattggaaaataactttactccccactttatgaagaaaagccataccataagcctttattttcttgtggcttctattcccatctgtgtattgatgattttttacatctgtaactccatcccatatgttactcccgagcttgattgagttccataggcactcccaactcaacattcctaaaactcagtttcctactcctcaccacccctgtgatcagctccatccatcagcactcaagctggaaacccggggagggatcattcttgatgtttccccgcccctacactacttgcccacatctttccactgctgtgcctcctggaacccacccttgttctggccatctcagcttttttgcttgtttcccctcagctcttctgtccccaggctctcacacccagatgactccctgcccaggtcttgcccagctccagtccattgtcccaccctgtggctagaaagatttttctaaaaattcctgtttcctttatgttcttatgcaaatcctggatggagctttgagataggaggtgggacttgactctagaggtggggatagggcattggacccaaatgaggactagctaaaacaggaataggctgggagcagctttccataagacacgcacagcagtgtgctatgtcagtttaccattgccatggcaacacccaggagttaccacccccttcccatggcaatgacctgacgacccaaaagctaccatcctttcctagaaatttctgcatagaccaccccttcatccacatgtaattaaaagtaggtatacatgtgactgcaaaactgccctgagctgctgctctctgcctatggggcagccctgctctgcaggagcagtcttggagctgtaacactgctgcttcaataaagctgttttcttctaccctaccaccagcttgcctatgaattcctaagtgaagccacaaacccttacgggctaagactcactttggggctcatgtgtcttgcctcagcttctctactttacttgggaaatcccaagtcctaaaccctagagttcaaggacttcacagttcctcactgtttacctctccagaatcatctgttgttgctcgctgtacttagccatgctagaggataagaatcctctagaatgcttattttaaatgcaaagtcttgagaatatggtttagtagatgagctccaagctcaggaaacttgtttcgacaagcactctgggtgattcatatgtagatggtttataaaccacacctggagaaagcctgctgctcaggtggtacctgggctatttcttaaagtttcattctctgtttcacctttagcatttccacatgctgtgtccattgcctagaacagacttctctgtctcctcttaccccttccttacccccagcccaacttggctctttatccttccctttcagggtgcagtttacaagtggtgtcttctgggaagcccccacgatcctttcaaagcccaattagtagactccctttctttgtacatgctgaggaacttgttacattgtcactcctgttcactctgttttctctgcttgagctgaggagctcctgcctttggtgacccttccaacttgggtattttcaaagaaagggcagtgttgtaccagcaccagcaccattaaggaagatgcctatcacttggcagcacaaatgctactgacattacatggtgatgcatggttttcatcctttccttcaacataatgccaaaggcaaatttctcttaacctgttatacatcttgttggctttgcttgggaagaagcaggggatatcccaacaaaagtctagtattgagcacaggattaactaactttcaacaagacatttcagtagaaggaaattaactttgcttattaagtagatgatgggttttttgtaagcatatttttaaaatttgaagccttatttgtccatgatacttaaagatgaaatgaagaccttagatcatttagggttatttgtttctgtgtttgcaggtttccattggaagaggggagcacttctggcaatagctaaagctattaaccatcgcatgaaaaagatgattaggttttcagctttcaagtgagaatgctgctactttaatgcccaaatgtatcaacatcggcaaaatcagatttagctgaacaattataatagaatgggctgcgctgccacccatgcttttagatgtccagggtaaaaataatttcccctcaagcctaattttcgaattgtttgttttattttccccataaaatagggaagaactgtgtgactcaatttcaacattcctgtatttattatcaacatatttcacccactcctacctggcagggcatcaggtttgtgcaatcagtgactatcctgggtcttgtcaattgagctgttgtttggcgtgtggaaaccagagagattcacttcatgttacactctgggctatgtgcagtttattgctttctgcatgttaatgttgggtggagagaactttaaatgtgtcatagattggattttaatgagaaaaataaaatcaaaggaaagggagaaactgaatgcaacatcaggattttaaggaaaacatttcttgttctgatttgattttatttactgcaccaaatgcaccatgtgtcaagcatattctattcaaataagatttatgaagtactttttcttatttatttatttatttttggacagagtctcattctgtcacccaggctggagggcagtggtgcaatcatagctcactgcaaccttgaactcctgggctcaagcaatcctcttgcgtcagcctcctgaatagctgggactacaggtgtgaacgaccatgcctggctaattaaaacaaattttttttttttttttttttttttgtagaaacaagatctagctatgttgcccaggctggtcttgaactcctgggctcaagcaatcctcttgcctcagcctcccaaagtgctgggactataggcatgagccacgatgcttggcctgaattatgttttaatgaacggtgtcatgttggtgccttttccaaagcatttttgtttgatgtgttcaatgccatcattggcacttaacactcttcccaatagttttcatagatacaccatatttttgtggcacttattgcagcatttttttttgttacataaatatacagaaagtgtttagcaatacaagatagctgagttatgccattaaaaatgtatgcacagtccctgcatgcatccaaaggatgctgagcaaccagcatggctttcatgtgtcctgtttctgcccttagtatccgttatcttcctgtgtcctagaggccaaagtcccaatgctagacctagtggtccggagttcaccaggtcatccctcctggagccactctctcccacagcacccaattgctccaacataccttctctctctttgaaacagtttcacaacaagaaggtgctggaaaggaaactatgtatttctcacactgtgctgcttcgcacctctgtaactttgtctcaaaaaacccaacacagagtgttgttggtcattcagtgggaggcgccaatacttttctctcaagtttttaaaagatcactaagtaaagcatgcaagtgaatattcacatattcagcttctgtttatttttattatttttttttagtgatgggggccttgctgtgttgcccaggctggtctctaattcctggcctcaagccatcctcccatctcagcctcccaaagtgctaggattgcaggcatgaggcaccacgcccagccctcagtttctgttttaaaatatctgactttgttcatgcagagataatctcataaatgaaagatgattaaagttctaatgagaacctgtcaactttctaaccttcaacttcgcttacctactctttggcatgactatcttaatctagggatccaaaagaactttggatattgttacccagcaacaagctttaaattataatgaggttaagtaagtttgcccagaatccacattgtatcaacaacagataccttgccaggattaactaaactccattaacttgaaaagccctgtaagtcaagattgccttcttaagtataaataaatataatgcttcaaagaaaataaatactgtgatgttttgagtctttactgtatttgaaactctctatatggttattgtgttttttttttctcctcctattcaattggccggtggtttgctcttgtccccactcttcacacacatctactcaattgctaagtcctgtcagtgctccctcctaaacatctggaatgctcactcgctactcatgtccaccttcctccagccctggttcacactaccatcacctctcatttaccaccttgttctctgtatctagtatgaccagaatgtttacttaaaagaaaaaaagaatcagtccacaaagatgaaatgcaaaccactctaatttggcttagacttttctgtttctgtttctcattctcaatagcactggaattttctgtggaacatcattttctgactcccaaagctcagagttaagacagttgtgaaaccaggaggtcgaatgggacagaatgggaaggattcagtcatatacttataatcttgtttgtcttttctgtggcctggaacatgtgtttcctgagaattttaagaaagggctcctttctcatccagctgtccacctgagttggtgaccctatgtgtctgggtggcaggcaggtgtggcccacagcttgcctttttctctgggtcatgctcagcaccagtgaggcaattgttttttgcctggggaacagggccacctacacccctgaagatgctaaatgggtgttattatttgataattttcagtgatctactgttcttactaatggagtgatccagtgttcactatgactaatgttgacttcttaatcattagaaagtttaggaaaactagtattatattattaatatataattataactatacaatacataattatatatattaatgtatacaaaatatgtaacaacataaaatatatatttggtgcatattatttcaaaaagttgagtagtttgttgtaatgaatgacattattggcgcttttcacattcttaaaatatttttgtttttgttaatatatatttggtgcatattatttcaaaaagttgagtagtttgttgtaatgaatgacattattggtgcttttcatattcttaaaatatttttgtttttgttaatatatattttattgtcaataaaggccacatattatttttgccaaaaaaggtattagaaaacaagtttatttattttttaatttttgatatgggatcttgttctgtcacccaggctggagtgcagtgacccaatcacagctcattgcagcctcaacctcctgggctcaagtggttctcctgccttatcctctcgagtagctgggattataggtgtgcacaactgcacctgactaattttgtattttcgtagagatggagtcttgctatgttgctcaggctggtcatgagctcctggcctccaatgattttactgccttggcctaccaaagcattgagattataagcgtgagccactatgccaaggctgattttgatttttaaaacttttttactttgaaataatttcaaacattcagaaaagttgaaaaagtagtataaagaatttctgtattcaccaggtccttgaataacatcattctgttataacattgatgagaaaaaaattgattcctgccagggtccactgtttgtggagtttgtatgttctccccatgtctgcatgggttttcatctctgggtccttggacttcctcctgcatcccaaagccatgcacgctggtgaactgctgtgtctacatggtcccagtgtgagtgtgagtgtgctttgtgataggatggcaactgtccaggctggttttcacttcccgacctgagctgccaggatggctcctgccacccatgacactaactggaataaatgggttggaaaatgaatgagtgaatacaaatgattataaagcaaacattcctaaagtctacgataaccacagaaatgcacaaaaatagatgacgcaatatgaacatgctcagtgagctgccacatttgtgattgcttttgaattgtgtggtgcaaggagatgctcttgacaatttttgctttgcaaacatttattccttgatttaacccaccaccgcttcgatgtcatcactcactgagtcatcaaaaattgggtaaataattctttttcttgtttttatttacctttattaaattaatgaagagttctcatttatttaagtgagaattgaatacatttatttcaataagcgctctccataaatttaataaagattaataaaaacaagaaggattaatagtaaagtgttttgtgtctttgtttagaagtttgatgatgtttttatgaccagaaatgtgctgtaggaacttaactcttacttatatcaattaacctatgggaaaactggtttcattatatgtcatttcattcattgtctctgtttccaagaacccattgatgacattcagtgaggacgtactgtagtctctctctctcatctccctccacccacagcattattattattatatatttttctgaatcatttgagagcaattgctgacatgctcttttaccctaaaacactgctgtgtgtgctgcctaaaaacatggacaggctcttgcataacaggtacgtccgtccacatcgggaagtcagcatcaatacagtgccaccacccagacctcactcagatatcaccagcggacccaaccatgttctttgcaatccccttttctcttcgggaataggattcaatccaggatctcatgctgcacttagctttcatctcattttgttttccttccgtctagagtagttcctcacattttccttgtcttttgtgatgttcatatttttaaagagtagaatccaggtgttgaccttcatttggggttcagctgatgctttgtcacgatgagattgaggtgatgcatcacagaagggactttttaggctgggattggccagtccacaccgctttgcacatgacttcagatgccctctggagtgatcatgggttttgtgagtagttcataacttttttctctcctgttccttttttaatttttaattttttttttttttgagacagagtcttgctctgtcacccaagctggagcatgcagtggcgtgatatcggtggctcactgcaacctccacatcccaggttcaagcaattctcctgcctcagcctcccgagtagctgaaatgataggtgctcaccatcacgcctaatttttgtatttttagtagagatggtgttttgctatgttggccaggctgttcttgaactcctggcctcaagtgatctgcctgtcttagcctcccaaagtgctgggattacaggcatgagccactgcacccggccaagttctcactaatttttgataagtcaaaagttaacctgcccctgtggcctggcatccacttcttcagcagttcctatccagtgccactaaaaggatccctcatcactttgctaataagaacatcctctatgagtcagcattctggcatctcccagtttaaatgcacgaactccagcaaaacccaagaccaactacatgagattttgcattttaacaagtttcccaggtgactcatacacatattcaacttcgagaagcacagctctgggaacataaaatctgcattatttcattaattttttaaatatcagatattttggaatgtgttaggcaatgtgggagcctgtgggagaaggagtttgctttgttacttttattttctgatcttggacaaaatgtatttaaattttgaatacattttatacttctcctttaaactctgaaacaaaaatcttcaacctcaacagttctaattcacttggtctagtgtgggtccccagcacctatattttctaaaggctcccccagcgtgcccctaatgtgcacctaggttgggccattatcacaactctaacacatgtggaagtcacgaattaactgcataaacatacagcaatcataggaataaaatacttccaatatcgtggcctcttaatcctagaacttttctccagtcttttatcttcctctctattttattcccattcaatatccttgtcatggttaagaaatgtgccccttccaaataccaattgcaaatatttcactttcagaccactagctcctgtctttagctcactctctgtagtgcctggactccaatgttcctgggccttactgaacccctaccagctatgcctccctccacaagttcatgtttcccaaccccctcacagcctcattgcctgccttccacagtgggggcttcatcgcccatcatcagtgactcctcccttggctgcacctccaattcccttgccctcacttacttctcaccacttgcttggaaaactccaaacctggttaaacgctgctctcttcctgctcactctgaaccgtgtagcagaatatgccataaaacaaacaaacaagcaaataaaaaaatcccagatcatgttgacccaacaactggtctcactttaaattcaaccacctctgtccagcagttccactcctttccctagtccaataactcgcccttgtgctagatgatgatttcctaccttagtcattcttcccagacttacagctcctccttcctgtccccactcagtgatgctttttcttatttctctggaaaaaaaaattaaaaaaaagttctgcaagctgctaccatcacctccagcctcctctgcacctgaacacgtttccttggccttctgactgttcctgtgcccacccaagaccatgccctccacttatgctctggatctggtcaagccaacctttgctgcttcttctgggtcaccagtttgtgtccactgaatcattttcatcaactttcaaccatgctttttcattccatttaaaataaactcttcggccccaccctcccaggccagctactgcccctctgctctgctttgctgtcttgtctttctgtggaaagcctctctgaactcattttgccatatgtgtaatggaagagaatgggatagagagagagaaaagctaggaagagagattagaggggaggcagagagtgggagggagaggttagaaagttaattctgattcatttaagtttataatatgtaactgggtatcaatctattctaggattcacttatttaacaactatttattggttagcaggcattttttttttttaggtgcaggggatacagtaatgaacaacagaaaaagaaatccttccccttaaatgagagatcgggtttcaccatattgaacaggctagtcttgaactcctgacctcaggtgatccgcccacctcggcctcccaaagtgctgggattacaggcatgagccactgcacctggcctgttcaagagtttttatatcacttaatctctacctcctcttcctcttcccagagcccagtgagtggggctgaaagttccaagaccctacttacttggtctttctggtgaccagccgcagcctgaggctatctagggatcctgctctaagtcatgccatttgcataaactcagctgtgatgaaagctgctcattatgaattacaaaggacactcctatcactcaggaaattccacgggtttcaggagctctgtgccagaagccagggtcaaagaccaaatatagttttttattaaaatcatagtgacctttccttccttttcatttcataaaagaatatcctttggatattctacctggttgtctttaatccaatgaaagattattgatctcaggtcagatataactccctttcctctgtcctaattaatgtcacttctagagacatttctggactgtagtttctagtgggtttgttttgtccattatcggtttatttttaactgcctttctttcaaaacagttcctatttattctttcattttcagtcacaatatgtgatagttttatggaacagttttctcctttcttttaaagcctatagatgatgacatttaataaatgacatcagatctttttaactgcatgatgttatcacatagtgattcttatccacctccatacgttgtttctaattgctcttgtgtcagacagttggaagctggccccgaactgtgaactgtgagcagcgtggggaactcagccttgcctctattaaagcatctttgtcagaagactaaatttttaaaaagctcttttgcatcactaaattagaagagaccatatcaaataatattcactgctgatgagatggagttaaactgatactcatgcttccttggcaactttataaattcacacaaacttttggaaactaatttggcaactaattaaagagctgagaaaaccttatttaaattatttaaaaaattctattgagacaatctaatatgggaaaaaacttctctaaaggagaatgtttattgcaaagttagtgaaaagggataaaaatcatagaaacaaatctccaaaatggaataataaataaataaaccatggtatttttactctaaggaacattgtgtggcaatcaaatatatggcaatgtggaaaaatttatgttatataatattagattaaaaaatgcaactatgtacatggtaattacagccatctacagagacatatttaaaaaatcttgcaaggaattttttttttttttttgagacagagtctggctctgtcatccaggctggagtgcagtggcgtgctctcggctcactgtaacctctgtctcctgggttcaagcaattctcctgcctcagcctcccaagtagctggaattacaggcatgtgccaccacacccgtctaatttttgtatttttagtagagatggggtctcaccatgttggccaggctagtcttgaactcctgacctcaggtgatctgcccacctgagcctcccaaattgctgggattacaggcatgagccaccaagcctggccaagaatttaaccagaataatgataattaaattatgaaagcagtagggttagagatattaatttttatttattatttttcaaatttcatttaatacagttatattacttaaagtttaaaataatgttctagagtagggtcataccatttgaatttggaaaatcctgatatattgttgagttgctttctaggatggtcagatgtagcctaatatagtgtatgagaatgctgatttcactacatactcttcaccagtgaaagctgtctttcaaaacatctttgttaatttaagaagcaaacatgacagcttctgctgtcactcttatcctttgatggtaaagttgaacatttttatatgtttgttggtcatttgtatactgtcttctaagagtttcttacaagtttgcttatatttcttttcttttcttttttttttttttttgagaaaggggtcttgctctgtcacccaggctgaagtgcagtggcatgatctcggctcactgcaacctccatctcctgggttcaagccattcttctgcctaagtctcccaagcagctgggactacaggtgcacaccatcacacctgtctaatttttgtatttttagtagagacagggttttgccatgttggccaggctggccttgaactcctggcctcaagtgattcacccacctcgggctcccaaagggctgggattacagtagtattttttttcataattgatttttatcaggtctgtatagattaaggcataaatggtcttttatcattgtattattcattttttgtttttgagacagggtcttgctctgtcacccaggctggagcacagtggctcgatcacctcagcctcccaagtagctgggactacaggcatgtgccaccatgtctggcttatttttctatttttgtttttttgggagagatggggtctcactatgttgcccaggctggtcttgaactccgggcttcaagtgatcctcgcacctcagcctcctgaaatgctgggattacaggtatgagccaccacgcctgactttcattcgtttgttttcattttttgttgattattgtattactcttatctctggttttcccctttttatttgttaaataatgttattagatataaagatttttgtgtttttttgatggtttttttttttttttgagatggagtctggctctgccgcccaggctggagtgcagtggcactatcttggctcactgcaagctccacctccaggttcaagacattctcctgcctcagcctcctgagtagctgggattacaggcacctgccaccatgcctggctaatttttgtatcattagtagagacagggtttcaccatgttgtccaggttgatctcgaactcctgaccttaggtgatctgcccaccttgggctcccaaagtgctgggattacaggtatgagccactgagcccgacctaagtataaagatatttaaaattttttcatgcttaataatatgggtttcactatgattttcctatacataactttatagtttttcattgtgagctataatgtacatcctgaagtgtgtgaaaatgtgtgtatgtgtatgaagaaatataatgatgccaacactccagaagcttccttcatctcttattcctcttctttatcacaatgttcctctttgctttagcagtaactgcctgtggtaggcatcctttatgatggccccgattggtattcatgccctgtgtaatctcgtcccactgagtgtgggctggactcatggacttgcttcaagccaatagaatccagcaaaaacaatggtgtgccatttttgagtagatctgattgtggtttctgtttctgccacttcctcctctctcctccagttccctctctcggttcttgctctaggggatgcagatgccacactatgagcttcatggggcaaggaactaatgtctcctgccaacagtaaggactgaaggcctccaacaaccatgttaatgaacttggaagcagctcctgccccaatccaaccttgagatgaatgcagcccaggagtaccttgattgagcctgtgggagaccatgagccagaggcatccagctaagccacaatgggattcctgacccacagcagctatggaataataaatgatttttgtcttaagccactaaattttggaataaattgttttgcagcaatagaaaaccaatacatgattcacctttatggttataatttttctttttattatatacataggcctccctaaaaattaaaaatcaataataggtatatcctcccatatgcattatttataactatcttttgtaccataatgattgcagcatttatcaatcttgtgacatgtagctatagtttatttttgttgttttatgacattccattcaaatatacatcaatttattcacttactgttgatggatatttggtttgtttgtaattttggttgttctgaactatagtgctgtcaacatttttgtacatgcacactggtacatatatgcattcatttctctggaatgtgtacctagaatttgctgggtcatgagatattgatgcctttaaatcttcatcaccaaagtattttttgtactgttatattaacttattctcccataagctggttattacagttttttgactccactttcttgtcaactgttatgagacttcaaatatcttaccaatctggttagtatatgatgctactttgtggttttaatttccttttttaatgcaattgagcagcttttcatgtatttatcggccactgggatttcctctttgtcaagtatctatttgagtcattttaatttctactgggtctgctgtattttttaaaatttatttatagactttgaaaataatattctgcatgtaagttcttttttttagttacatgttgcaaatatcttctttcattttgcaggatgtccttttttattcttatggcatgtttatttgaatgaaagttctatcttgtttaagaaatcttccactaccggaagattgctaagctattatcttaaatttttttttctagttttgcctttcgcatttagttctttaatccttcttaaatggacttttggtatagacgtgaggcaggagtcaaatctatttttcctgcatgaatacctaattgccccagcatgttttgttgaaaagtccgccttttctctgctgttctgctttgttataaattttgtgcctgtgtctggatagcgtattctgttccattagtctttgtttctgtccgtgcactaatagctcactgtctctattactatagcttcataatgagctctggtatctggtagagcaagtccttccacttatttcttttcatgagtgtgttggctattccctttgcagttctatatatatttaagaattagctcatccagttacatacacatgtacacactcttaggattttaactgggattgcataagctaacttagaattcatgtctttacggttctgagccttacaatctgaacatgttgtatctcccgttatttgggttaatttaaacatgttttataaggaaatttataattatctttatagatattttgaacatatcttgcacagtttaatctaattacttgataattttgaagctattaatggtattttttaaaactttaatttcctggggtttgttttttgctggtatactgtaattacatatatagagggggtatattttattaaattatcttattaattctaagagtttttctgtaaattcttctgaattgcttatccaggcaatcatgtcacctgtgaataatgatgtcctttttaatttcttcaattcattttatgctaaagaaataattccctctttctagaacaaataggcattgatttctactattcttttatgattttgtaaaaaaaacacttataatgttaaaaaattaatattaatttacctctagaatttatttttatgtgttttaggaaataagactccaactttgtttttcccaaagggttaaccaattgttcccacaatataaatttactgatacacccatttgcccttttagcatacactaaatttctgtgtacactaaggtttgttttttgttgatctaacctgcttcattgacttgttggctgtggcactgattactgttttctaatacccttacatgttgatacagtgattaattctttaaatgccaggtctcttatcaacataagagtaaattttggaattatagtcatattttaggagatttttttaaatcactggcaaacattttccaaacccctaaggggttgcatccagttgtctttggtgtttcagattttatgatttcatagttattaaatcactaatttctatgacaggaagggacagaagcatagaattgttgagtgagaaagaccccaaggatagctcttccagactctcaccttgaacagtgacttattttagcaggttacagccttgcacatggccatctcacctttacctggaaccttcaatactaggaagtgagctatgacactgcgcagttcagtctaggtttcaacgatcctcggtagtgagttctacctggacaaatctcactctgtacaaggtccatccataggtcttacttttgtccttcagaaacacagagacttgcttaaatctcttttatacatgtttgctattttaatattgaagacacatatcaccacacctccttaactcttattttcccagagtgattatttccaatttcgcctctgaggctgggttatcccagcctacttgtgttcaaagtgtttggtaatttccccctttcctacacacctgccaataatagcaatagcgacaattacaatacaatgaaagcgatgtaacactgagtctaaatagtattcaaatgtggtctccaggtaaactctatattcctttgatttatggaccccactaaggaagccttggctgcaaataagatatgtctcacctattggtaagtcaaaaaaaaaaaaaaaaagaatttgattttttcacatcacaagaaatctagaggtggggtcgggggtgtcactggcattaagtgagaaggtcaagtgtgctaggactctggggctcatccctgcagccctcagtcttccctgtggctccacgcatcactgcatttatcaaagatgagaagtgggtgtggtgcaggcaaggcagaatttcacctcatatgcttacctctaagtgaggaaaatccttcccagatggtcccaggacagcggcttaagccttgttggccagatttgtgtcatggatccatcccagacctcagactggaaagcttccctaacaacaaaatattttaactcaaaaggttttcaggagtttgagaccagcctgggtgacatagtgagactcccatctctaaaagaaaaataatttaataaaattaaaaaaacaaaaacaaaaccccacaaggactaagaaaggggctagctttggagtagatgagaaacagcatctgccattatctatatatttatctatatgctttactactattgatgtatcttctggcactagctcttttattattgttattttaaataccccctccccacaccccagtgtatattgatctaatgttcactaatactcttagaaattgatactgatggccgggtgtggtggctcacgcctgtaatcccagcactttgggaggctgaggcgggtggatcacctgaggtcaggagtttgagaccagcctggccaacatggcaaaaccccatctctactaaaaaaacacaaaaattagcagggccctgtggcggctgcctgtaatcccagctactcaggaggctgaggcagaagaatctcttgaacccgggaggcggatgttgcagtgagccaagactgtgccactgtactccagcctgggtgacagagccagactctgtctcaaaaaaaaaaaaaaagaaaaaaaaagaaattgatactgataaatttaaccaatacaatctgaatatggttagtaacaaacaagtcacctgtcattcaccttctaggtttggttctgccaatcagtaaaattacttttggcagcaggtgacataatacctgaccaaacatggcttaataataagagtcatagctgggggtggtggctcatacctgtaatctcaacactttgggcggctgagtcaggaagatcacttgagaccaggagttcaagaccagcccaacctgggcaacatagcaagataccccacctctacaaaaaataaaataaaaaccttagctgagtgtggtggcacaggcctgtagtcccagctactcaggaggctgaggtgggaagatcccttgagtccaggagctcaaggctatagtgagttatgattatgccattgcactccagcctgtgggacagaatgagactctgcctctaaaagaataagataaaataaagctcactattaaatgccacataacaagaatgagacacttaggcaattctatcattgtttaatacaacccctcaatgatatcagagctccaggtagacaacatatgtccacatcaggatctgcccctcctttccttcctttccttctggctgctatgtctgtaaactcggattaagttgcaatataacacatctaaaggcttgctgggcctcataagggagggaatgggctacacctaagaagaacaacaaggcctatttggcatgcaattgaggaatactctggggattctaagggtgcgtggtaaaagtggccagaacatcaggtagaaagaagagagtttattgttttgggagtactttcttgagatactggatttaacaccctatcactcaccctgggatggctcctagaagcatggagaaagcagcaacatggaaaaagcaacaaacatggaacaagcatgcttttccaaggggtcaagcagtctctaagcagcaggcagctgctaggtcagcccaccacacttccatccacatggccaagaaggaagcaatgagtccagctggatccagacagcttagcacagcaggcagtaggagcttcaagttcacactgggtcatccatcctgaccaccaatttaaaggaggtgaggcagagtgggcccaggtgagtactgttcacgcagagcctctgtcacagctgagacattccaagcttaggacaccctgatcttatgtaggagctgctaacatacctatcacttctcccctctggagatgtattctctttcattatcccagaatgtcttaggggggggaggcagattctagctgtcttatcctgaaatgtgagcaaatctgttttctgcctcagagcagctttgctgatatcgttgaacactactgtcaatgccttttgctcaaaagatgtgaagaaacaccagaattgtctcccaacatgcaaagtgaaattgaaatgccaaaattgccatggcagaaggaattaaaaggctcagtgaagttggcgtgctatgaatatgccaggcaaggctggaaggtctattagttgattatgttccatgaaacagctaagaggatacaccatttaccaagacctcaagcaacacactagcaaaaagaatcacgaaaatatatttgttggtagttctataaaccatagctgattgtaaagaggcaattttacagatctaggctcaccgataataaagaaggccatagaaccctagagcaatagaggccaagtggtgagacagtctctgaaatcagatgtatgcaactattacaaggagaggcaggatcagagtggtggccaagaaggactgatctgcaaatgttatggatgtggttaatagaaccagcacctctaaagacaaacagatgggcaatactcattttatacttgcagaagaaatagaggatggatggccagaggctgaaaacagtctataaagtcataattgcttgcacagtttccagacctgaggcagttttcagacttggaaaccatggactaaacaggaggctggatttccaggagaaagcatcttgtaacacaaggcaaacacagatagtaatgatgattcccatagtccttctccaaagggatggatgcctgtatactcatactcaggtaacagtttattggacacatgccaggcagcttcttggtccaaacatcagcactctcagttttagttataaggaatattatatggagctcagggatcctgggagctttttggggctggagaaaaaagtcatgccaaaggatactaagtgaaagaaaaaacagtctgttaaaataaaggaaaataaaataaaaaaggaagaaaattagattatctaaagtttaaactaggctaaaccactaggggaaaaaaagtgagacatggtagagaacaataaagtatagtcataattaaaataatatttgcctgttgtttggaacagtgtaatggaaagaacttcattctaagaaagttttcatgagttttttttttatgtggagaaactgtagtcagtgagtatattttaatgacttttttttttttagtaaagatggaactattttaagtgttagcatctaattatttaatcaaaagacagataatttctaatggagtatgattaggatgttatatccagccagcaataattcctatttgctgctaatgaatatattatatacaatcttgagatatgttttgttaatttaattgcattgtcttacattctctttgatactgacagtctccaggggtaacccaaggggcaggagagagttatttctatagaatttctgctccagagaagtttcatgtgactcatgcgctgccgggaaagtgctgtgtgtagaagacgaaccaggaacattcagagcctgtcacgtaaacggggagaaatatcaattatattaaaattgttgaaagaatgaatacatttcctacatggaacaggcctttacatgtatatgtataaatctgggtctcttttatgttgtttgcacttatatttttgtttatgcattcagattttgggatatgtatgtgtgtgcctttgagagtgaggacatgatggagcagcacctttgtaaatgtaagactttgaaccataaagcaagcttgagaacaaaataaaacaatgcaaagcatttgaagagtctctagtttcttctctgccatttagcagctattgacgtggtgaaaattccttcattctctgggcctggggttcttgtaaaggacaaaggacaacctcccctaccttagcacctcctccaaggaaaattctctctgtcctgagaatgataagcaccaacttaaaaatatgtgtatatataaacattgaaaatgtaaaggagatatgatatatacataatatacctatatccatacatgtgtgtataatcactctccttaaaatttagaggcaagatatgcaaaaaatcattaatagtggtttcctctggggagtggaataaatttgggaaggacatttttacttttcaattcattcctttttctactgttggaatttttactctctctttctctctctctgtgtgtgtgtgtgttacattagaaaaataacctctcttaagtcttcatattgtttcagcttgtgttcttctgcacagtgggccccataagatgtggtttctgtttcaacatcagacacagtctttttctagggcccagacaaaactagtaactgcaaagagaaagcaaatctgagggaagcaggtcagcaacatctgccacagcattgtgttcaaagggcctgagagatttgttttcgataagctgcagtaaaacttatctgcctatagacagaaaaacaggtaaataagtctatacaaatttttattattttaacttagacttacaaattgtttatatttgtcctacttgccatatatatttctctttctgaaacgtctgagaatgagtttcagaattgtgcttctttgcccctaaatacttcagtatgtatttcctaagaatatactaagaatattcctaaaaatacaaccacagtacaactattcaaaccagaaaacttaacatggatacaaagctgttattcaatttatagtccatattcaaattttggtaattgttgcaatatcttttttttttgagacagagttttgctcttgttgcccaggctggagtgcgatggtgcgatcttggctcgctgcaacctctgcctcctggtttcaagtgattcttccacctcagcctcctgagtagctgggattacaagtgcctgccaccaggcccagctaatttttgtatttttagtagagacagcgtttcaccatgttggccaggctggtctcgaactcctgacctcaggtgatcagcccacctaggcctctccaagtgatcctgcaatatcttttatagcattttcctcagatctgttcaagaattacttgttgcatttagttttcatgtctctattctccttaatctggaacatttcttagtctttgtcttgcacggccttgacatttttaggagaacaggacatttattctgtagaatttcttttaatttgaatttgtctgatatttcttcaagtttagattcactgtatgcaagttttggacaaatactggaagacgatttgtacccctttttgaggtacctgatggtcgagttgatgtggtatctgtagatttcttcactgtcaagtttctattttcctctctgtaactaatacatattttgtgaggagatacatgcacacaacacatgcctatatttatatatctataaaaaacaagcaaggccccatctctacaaaaataaaaataaaattagctgggcgtggtagcgcatgcctgtagtcccagtactcgggaggctgagctaggaggatcgcttgggcccaggagtttgaggctacagtgagctataatcatgccgctgccctctagcctgggccacagagcaagaccccaaaaccacacaaaaaaacagtcatactgatatgatacctgtagttccttccaatccagcactccagggtttatgcttttctttctcagttccctgttttaactctggtcatatggaagagagaatgaagtcaacatacacaaaagcagaaaaaacctggacagaaatccctggtgctaacgtaaatccctctacacctgcctttctcaagggttttgaaaattccaggaaacccttctttttctaactagtctagttggattttagtcttttgcaactagatgattgttgactcatactgtgatgagggaaaatccagtgtcatcatggtccctttgacattcacctttacaaatagttttgcaatgataactcactaatttttacctttgtggtgttttactgtatctccctgcagaattgaggagactgacatttattacaatgctgtactgcaccatttaggcatgacataaaatttaatccttatgataatttgtagcattagtaagagaatcctcattttgcagataaaagatttgggactgagagaatttaagagacttgtaagggacacacgaaacagaataagatccctaacctctccgtaaattaattttcttccccacacaattttgccttttacctaactccttaccctggcaattcattcattcaacaactgttttctgagtactgtatatgtcgttctttatcagagtcaattaaacagacttgtcaacacctgtcaaccctgttggttgctttagtactttagagagattttaaattacactcacattataataggaaagtgctaaagaaaaaacaaacaaaccctgagtcaaagttcttgtactcaaagagttataagtaaactacttacatttaaaaccgtatctgattttctagagaaaaaaatacatgttgatatttatagatacttattggtaaatatttattgtatacaaaaataattgtcatgatttcagtccagatttctcagagatggccccttagaaagtttacttggagtaggtctgactcatttacatgattcaatcaagtggatatgacatccatacaaatagtcataatatttgaaggttattaaatgatgctcaagcagaaacatgaaacacgattaaggatgaatggtgtgttttatgcccttgaaatcgctaggatatgagatgcctacggctttgctcactctgcctcttggccaaccctgatgaagacattcggtgtccttctgtgctttcatgtgtcccttagccagagccaaagagtccagcgcacagctgtgctggggcttcagaggtttttggatgcctctgtctttctaaggaaagagactttccttagaggacttcacaagatcagacagctgctgccctgagtgctctaagttctcagaaacacatcatttcaagtttagaaatacagggcccacatattagagtccttgttaaatcctcatgagaaatgaaaaaaggctttcccccaccactttcttcagccagcaaagaaaagaaacaaacatttatttaaagtgccagatcttatgccagtggcactttgtacacatttttcttataatcctcataataactaaggaaaattattttaacaatctccattttgcatgtgagcaatgggttcagaggagttaacgtgaacaagatcacaagctggaaaaggacagtgtctgcagtcaaaccgaaatgcctttgactcagttcagcccttagaaatctgcagtgtggacttccaaagtgcccgcactccctggccttgcaggacttggaaatgtggctcatgtattcattagggtaactgtctgatccattatttgtaacggctgtgcctacattctaataataattgtatggaatttattattttaaattagacacatgtattactgaatatagttatttttacatagaaatcttactatttggtattaccaataattaatactgtgtgggcatgaattgctatgagaatcacatatttcgggtatgtgaagcactttataaaggaaataataatttttttttttttttttggagacagagtcttggtctgtcatccaggctggagtgcaggggtgtgatctcagctcactgcaacctccatctcctgggttcaagcagttctcgtgcttcagccttccaagaagctgggatcacaggcctgtgccaccacaggcctaattttttgtataatttagtagagacagcttttagccatgtttgccaggctggtcttaaactcctggcctcaagcaatctacctgccttggcctcccaaagtgctgggattacaggcgtgagccaccacgctgtgcctggcctggaaataataagtttggggcaaaacttgccattcacctattgatgacatgcacttttgatagttatgatttttaatatccaatataagtaaaatcaatataaaacaacagtgttatttaattatgtattatatttgttcattttttggtaataatgtaaatatagcaataatggaaataatatgtaaaaagaaatcttaccatgtttaccctatagaataaatacgtttttgtgcattagaaaggggaatattcttgtcctgactaattctgaataagcagtgtatctgaggacaatgggggagggagttgcatgtaagtgtgcatgtgcatgagtgtgtgtgtgtgtttgtacatgaatgtgcacccaacatctcctgctgattggcttctcctgagctataccacatttcatatttggttggttcctaatacatcacaatagcaaagtgctgttatataaatattaactattatatacacacctactatatacccacaaaaattaaaaattaagaattaagaaaaagaggttgaagggatgcaaggaagggactgcaagcctaggcatgcaggcagcccccagaagttggaagaggtaaggaaagagattctcccctagagcctccagagagatccagcctgggcaaccccttgatttcagcccagtgaaacccatttcagactctggcccccagaactatgagaaaataaatccatgctgtcttaaggcactcaaaaaaccccaaaaatattaaatattagtgtttcattcttatgaagtgaagagagtaaagaagaaaaaaaccaaaatgctcttaactccccttaactcggtaaagtgctttgtttttgtttttgtttttgtttttgcattctaacttgcattgatttggactcagttaattttcttcgttttttttttttttttttttttttttgagatagagtctcgctttgtcacccaggctggagtgcagtggtgtgaactcggctcactgcaacctccacatcctgagttcacgccattctcctgcctcagcctcccaagtagctgggactacaggcacccaccaccacgcctggctaattttttgtatttttttttttttagtagagatgatgtttccctgtgttagccaggatggtctcgatctcctgaccttgtgatccgcctgcctcggcctctcagagtgctgggattacaggcgtgagccacggcgcccggccggactcagttaattttcaaacaaaccacagtcaaatggtatcatgctgtttctaattagttaaagaaacactttcccacagtggttaccgatggaggtcttcccttgtgtgctatttaagtctctgtgccatggtgccccagtctctctctgctctgccatttttctctccaagttctttgccctccgtttccaagcccggctccatatcttgccctgctgctcatccagctggtggactagcatctcagtttgtgtgcttttgtaccataactttggcaggtttactaggtcaccacttccttctggtatttgtccaacagtgtttgaaccacaagcttgaggaagaccatctgcaacctcccctaggtcctaagagaccagcagccaggcccaccagacaaaacgaaatttcagagaccactgggctggtatacataattcagccaccgacagcatttggatctttctgatcccgtctttctttaaaaggtttatatttggttcatcctagattttttgcattcatttttatttttaaagtatggtattaagatatttatcttgatgactgagttttcttggcctgagcccaatgccttactcaccatagccgagccctgccctgtctggcatgatcctagatcccagccatcacctagcttctgagctccgcctttctgggtccgtgagccctccctcgttttgattcttggaggatgctctcttaaccctgcctactccttggcaattttgctttagtttggacttcctgctcttgttatcctggactttaccttgatgcccctctggtgcccggttgtcctcactgtgaccacgggagggggcatccctgacctctgcccacagcagtccttgtagcaccaggcagggccctgccggagaagaggaacgggaaacggatgtattaagagattgatggcgaggaggccaggcacggtggctcacgcctgtaatcccagcactttgggaggccaaggcggatggatcacgaggtcaggagattgagaccatcctggctaacacagtgaaatcctatctctactaaaaaaaaaaaaaaaaaaaaaaagaaaagaaaaaagaaaaaagtacaaaaaattggccaggtgtggtggcgggtgcctgttgttctagctacttgggaggctgaggcaggagaatggcgtgaacccaggaggagctttgagtgagccgagatcacgccactgcactccagcctgggcaacagagtgagactccatctcaaaaaaaaaaaaaagagagattgatggtgaggaattggctcacacgcttgtggggctgagtgtgcaggtgcagacacacagggcggacctcaggcagggcagctggacctcttcctgtgagaagccgctgtccacaggcggaattccttcttcctcagggaagccttggtcaggcctttcagtgggttgccttgggtccgccgggatggtctaggataatctcccttatctatagtcaactgattttgaactttaatggcacgtgcaggagaccctcacaggaaacctagatgtaggttggaacagcggagggctgtggctgggccaagttgacacataaaacgaacagtgccaggccccacggccttccagttaggccttgctttgtgctaggctccttgtaagagaagggaactttatgaatggttcataaaattccatgtgttatctcccgaaaaagaagtttctcaaagcagggcctgcactaagtacatgctctaaggctctaggggacaaggaaacagattccctcctagagcctcagagggaggcagccccgccggcaccttgctttcagcccagtgaaatccatttcagactctggcccccagaaggaagagccttgtatatattgtttgttttattaacagctctaggcttagcaatagtatgtcctgacactttacatcaattgcttgaaattggtacatatttccacacataaagaaacaaatcataaaggagttgaggctggtttcaaattacatttgctacatgacacaggagttcttcttggggctaggaaccaaagtggaggaagattcaagtttcaaggtgagaattctgttctcccttccagataggatttgttgcaggcaagattttacagcatgctgctggtgcctccattgccctttctgcgtctttctgcacttccccgggggcccaggcctcctgaggcagcaggtttcccactgtggtagctgcgccctgcccagggctctcagtggtgccgtgtaccttggggagggaccctgagtgtgcctgggattcccaagtccctgtattccaggaccgcattcgatctcctgacatgtgtgcagtacccgccctagtgtgaccctggactcttcctgtctctgaacctccagagtgtccaatttccttaccgctgtgcaacctcctcagacccgggccagctcagtgctttgggtgagagaatttcagcccaagtgaccagcctggtgggtcactcctgtcctggccccctgacctcttgtacaaggagaagtatggcctgctgaattttcgttaagcatggggcccatcgcagtaatggctgcttacgctggtcagggccaggatcaacacaggcatagacatcccctggcatctcaaaggtgggcctgagggacagtgacatgtaagcagtgggggatggcaaatacataccaactgtgggtttttgttcaatattccatataatccaataccttttattttgaaatggtactctgtgttggttaaacatcttgtaattgtttttcctgacatatactccatcacctagaaacaggtacaaaaatacaattctatttttagaaatcctgattgggcaccttctcttttgtaaccaaggccacatagagtgtttgaggaagctctgcctgcgtcctttgatggtgccccagagctgggctctgaccctgcccccagtggagacctggccatcgagcgggaactggctgtggtctgagtggctctagacacctggagtcactggtgtgcaggggctctcagccttgaagatggagatggcaaggatcagagcaagaaggagcaggaggagccccaagaacatgagaacattgcccaagccatcaactaggagaataaccagaggaccaggagaggcctttggagccacactgacctgagtcctgactctcggctctgcctttgatgtgttgtgtggctgagaggttttctgttgtgggtattgatggtgtttttttaattttaaattttattttaatttttatttatttattttttattatactttaagttctgggatacatgtgcagaatgcgcaggtttgttacataggtatacatgtgccacggtggtttactgcacccttcaacccatcatctacattaagtatttctcttaatgctatccctcccctagccccccactccctgacaggccccagtgtgtgatgttcccctccctgtgtccatgtgttctcattgttcaactcccacttacgagtgggaacatgtggtgtttggttttctgttcttgtgttagtttgctgagaatgatggtttccagcatcatccatgtccctgcagaggacatgaactcatccttttttatggttgcatagtattccatggtgtatatgtgccacagtttctttatccagtctactattgatgggcatttgggttggttccaagtctttgctattgtgaacagtgcctcaataaacataagtgtgcatgcgtctttatagtagaatgatttataatcctttgggtatatacctggtaatgggattgctgggtgaaatggtatttctagttttagatccttaaggaatcgccacactgtcttccacaatggttgaactaatttacactcccaccaacggcataaaagtgttcctgtttctccacatcctctccagcacctgttgtttcctgactttttaatgatcgccattctaactggcgtgagatggtatctcattgtggttttgatttgcattactctaatgaccagtgatgatgaaatttttttcatatgtttgttggctgcatatatgtcttcttttgagaagtgtctgctcatatcctttgcccactttttgatggagttttttgtgttttttcttgtaagtctgtttaagttctttgtagactctggatattagccctttgtcagatggatagatttgcataaatcccattctgtaggttgcctgttcactctgatgacagtttttttttgctgtggagaagctctttagtttaatcagatctcatttgtctattttggcttttgttgccattgcttttggtgttttagtcatgaagtctttgcccatgcctgtgccctgaatggtattgcctaggttttcttcgaggatttttatggttttaggtcttacatttaagtctttaatccatcttgaattaatttttgtataaggtgtaagaaagggatccagtttcaactttcttcatatggctagccagttttcccagcgccatttataaaacagagaatcctttccccattgcttggttttgttaggtttgtcaaagatcagatggttgtagatgtgtagtgttatttctgaggcctctgttctgttccattggtctatatatctgttttggtagcagtatcatgctgttttgattactgtagccttgtagtatagtttgaagtcaggtagtgtgatgcctccagctttgttctttttgcttaggattgtcttgctacacaggctctttcttggttccatatgaaatttaaagtagttttttctaattctgtgaagaaagtcaatggtagcttgatgagaatagcattaaatctatatattactttgggcagtatggtcatttattgattcttcctatccataagcatggaatgtttttccatttgtttgtgtcctctcttatttccttgagtggtggtttgtagttctccttgaagaggtccttcatgtcctttgtaagttgtattcctaggtattttattctctttgtagcaattgtgaatgggagttcactcatgatttggctctctgtttgtctgttattggtgtgtaggaatgcttgtgattttcgcacattgattttgtatcctgagactttgctgaagttgcttatcagcttaaggagattttgggctgagacgatggagttttctaacagagacaattgacttcctcttttcctaattaaataccctttatttctttctcttgcctgattgccctggccagaacttccaacactatgttgaatagaagttgtgggagagggcatccctgttttgtgccggttttcaaagggaatgcttccagtttttgccctttcagtatgatattggctgtggatttgtcataaatagctcttattattttgagatacattccatcaatgcctagtttattgaatttttagcatgaagggctgctgaattttgtcaaaggccttttctgcatctattgaaataatcatgtggtttttgtctttggttctgtttatgtgatggattacgtttattgatttgcatgtgtttaaccagacttgcatcccaggaatgaagtcgacttgatcgtggtggataagctttttgatgtgctgctggattcgggttgccagtattttactgaggatttttgcatcgatgttcatcagggatatttgtctgaaattttcttttgttgtgtctctgccaggttttggtatccggatgatgctggccccataaaatgagttaggggggattccctctttttctattgattggaatagtttcagaaggaatggtaccagctcctctttgtaactctggtagaattcggctgtgaatctgtctggtcctggacttttgttggttggtaggttattaactgctgcctcaatttcagaacttgttattggtctattcagggattcaatttcttcctggtttagtcttgggagggtgtatgtgtccaggaatttatccatttcttctagattttctagtttatttgtgtagagttgtttatagtattctatgacggtagtttgtatttctgtgggatcagtggtgctatcctcttgatcattttttattgcatctatttgattcttctctcttttcttctttattagtctggctagtggtctatctattttgttgttcttttcaaaaaaccagctcctggattcattgattttttgaagggtttttcatgtctctatctccttgagttctgctctgatcttagttatttttcatcttctgctgcttttgaatttgtttgctcttgtttctctagttcttttaattgtgatattagggtgtcaattttagatctctcctgctttctctcgtgggaatttagtgctataaatctccctctacacactgctttaaatgcatccagagattctggtatgttttgtctttgttctcattggtttccaagaacatctttatttctgccttaattttgttatttacccaggagtcattcaggagcagattgttcagtttccatgtagttgtgcagttttgagtgagtttcttaatcctgggttctaatttgattgcactgttgtctgagagactgttatgatttccattcttttgcatttgctgaggagtgttttacttccaactatgtggtcaattttggaataagtgtgatgtggtgctgagaagaatgtatgttctgttgatttggggtggagagttctgtagatttctattaggtccacttgatccaaagctgagttcaagtcctggatatccttgttaattttctgtctcattgatctgtctaatattgacagtggggtgttaaagtctcccagtattattgtgtgggagtctaagtctctttgtagatctctaagaacttgctttatgaatctggctgctcctgtattgggtgcatatatatttaggatagttagctcttcttgttgcattgatccctttaccattatgtaatgcccttctttgtctattttgatctttgttggtttaaggtctgctttatcataggctaggattgcaacacctgctttttcatgctttccatttgcttggtaaatcttcctccatcccttcattttgagcctatgtgtgtctttgcacatgagatgggtctcctgaatacagcacaccaatgggtcttgattcttcatccaatttgccagtctgtgtcttttcattggggtatttagcccatttacatttaaggctgatattgttatgtgtgaatttgatcctgccattttgatgctagctggttattttgcacgtcagttgatgcagtttcttcatatcactgatgatctttacaatttgatatgtttttgcagtggctggtactggttattcctttccatgtttggtgctttcttcagagcgcttgtagggtaggcctgattgtgacaaaatctctcagcatttccttgtctgtaaaggattttatttctcctttgcttatgaagcttaatttggctggatatgaaattctgggttgaaagttcttttctttaagaatgttgaatattggccactctcttctggcttgtagggtttctgctgagagatccgctgttagcctgatgggcttccctttgtgggtaagccgacctttctctccggctgcccttaacattttttccttcatttcaactttggttcatctgacgattatgtgtcttggggttgctcttctcaaggagtatctttttagtgttctctgtatttcctgaatttgaatgttggcctgtcttgctaggttggggaatttctcctggataatatcctgaagagtgttttccaacttagtttcattctcccatcactttcaggtacaccaatcaaacgtagatttggtcttttcacatagtcccatacttcttgggggctttgtttatttcttttcactcttttttctctaatcttgttttctcacttcattttattgagttgatcttcaatctctgatatcctttcttctgcttgatccattcggctattgatacttgtggttgcttcacgaagttctcatgctgtgtttgtcaggtccatcaggtaatttatgttcttctctaaactggttattccactcatcaactcatctaaccttttttcaaggtttttaacttccttgcattgggttagaacatgctcctttagcttggagagtttgttattacccaccttctgaagcctacttctaacaatttgtcaaacttattctccatccagttctgttcccttgctggtgaggagttgtggtcctttggaggagaaaagatgttctggtttttggaattttcagcctttttgcgctggtttctccccatctttgtggatttatctacctttggtctttgaagtcggtgaccttcagatggggtctctgagtggatgtcctttttgttgatgttgataatattcttttctgtttgtcagttttccttctaacagtaaggcccctctgctgcaggtctgctggagtttgctggaggtccactccggatgctgcttgcctgggtatcactggcggaggctgcagaccagcaaagattactgtcttttccttcctctggaagtttcttcccagagaggcacccaccagatgccagcctgagctctcctgtatgaagtgtctgtcggcccctactgggaggtgtctcctagtcaggatacatgggggtcagagacccacttcaggaggcagtctgtcccttatcagagctcgaacactgtgctggtagatctgctgctctcttcagagctgccaggcagggacgtttaagtctgctgaagctgcacccacagctgccccttccacaaggtgttctgtcccagggaggcgggggttttatctataaatccctgactggggctgctgcctttttttcagagatgtcctgctcagagaggagacaatctgggcacaggggccttgctgagcagggctgggctccacccagttcgaacttcccttggctttgtttacactgtgagggtgaaaccgcctactcaagcctcagtaacggcagatgtccctctccccaccaagctcgagcatcccaggttgacctcagactgctatgctggcattagaatttcaagccaatgggtcttagtttgctgggctccgtgggggtgggacccaccaagccagactacttggctccctggcttcagccccccttcaggggagtgaacggttctgtctcactggttccaggtgccactgaggtatgaaaaaaactcctgcagctagctcggtgtctgctcaaacagctgcccagttttgtgctggaaacccagggccctggtggtgtaggcacggaaggaatctcctggtctgcaggttgtgaagaccgtggtaaaagtgcagtatctgggttggagtgcacggtacagtccctaatggcttcccttggctgggagagggagttccccagtcccttgagcttcccaggtgacgggctgccccaccctgctttggctcgccctccttgggctgcacccactctccaaccagtcccattgagatgaactgggtacctcagttggaaatgcaggaatcacccgccttctgcattgatttccctgggagctgcagactggagctgttcctatttggccatctcgccagcaacagctggtgtttcttaacctgtaagatagggataacaatatctacctcataaaattgttttgaggattagaaaagatgccacgggtaaaacacctgcatcaaatgggtactgcatagataattgtcactattacgactactgatgtggggcaagagtcctcagaacatgcagagtgcttgattaacctcagtcaatgatggctgttatttttattggtggaaataataatattactactacaactcctactaatatgcagctgagggagaaattcaaggatataatgcgtgactcaagtttatgatatgtcacggtggagaacagagcaactagtttgcttggaaatgtgctttcactgggtcaaagacttgggcattgaggaggctgcagaatctggtggctgagtcagggaggctgggtactgagcaggggctcagctgggctgaggtctgttatcccagttcttagcccttcttaaagggtccaataaaagcccctgttgcatagtcccccaaaattcttagggcctagttctttttttccaattggtttacaaagccaattacaaaaacaacacattgacatttacagaatgtcgggcaaagctaaaacaaaggcagtgttgctcaactgtatttgagaagggcctgtcagaggatggggtcatttgagctggatttgatgcagcaaaacaaaatgctagattttgacaaaatcttaaatgaggactgctgaagtagattagatctggagtgacctaaggcagagcttgttctttgcagtaaaggaaagtagcctcctgcctgtgtgtgtctgtgtttgcctggggtagtgggcaaatgggggaagttgagggaaatcaattccatttataaatgaatccatttggatctcagcaaggacagatgaacacaccaagatctctcttatggggagcagtgtggcccagtcatgatcacctgggcctgaaacacctcatagttgctgagagaaagcacattgtagcaatacaaatcccttttgctgaataggcctgctggtatcatatccatttacactgctgcatttttacacaggtcacacctaatttaggtgaaaccccaaagcaacagccatcaactacatgtgctgctcaccatttccctcctttccacttccagctcctgatccttttggtgatgtctgttgctaaggaatctagtgtggcctgcggatatctaggtcatattgctgtggattaaaaggaaaaactagagggctcctttggagttagcagtcatcaccaaatgcctctggactgccacccaccttagctcagtccttcacctgtgcagctctgctttcgctttgcggatgcaagtcacacatcagtggatttttttaggaataatcttctttgtcttctctgtagcatttgggtattgactattggatacctgcttctttgattttgcatgaattgcattatacagattctctgccgctctcctatcattacttccatttcccatttagagtccccttcctcatgctcctcccagacatgaggttcacaaggttttctcctcttttctctgaccctgccatgcagaaatcactccttctcacaaggccaggaatcacctgaacacacaattcacagagcaggccttgccacgcacccctcccagaggttagctcacatcttcccaacttcctctgcattccgagacattctctccccttcctagatgctcgtggctgaaacagcacacatgatttcctttcagaattctccatttgagtggttggcatcatcagcattcacggcacccaatcttaaacctcaagatcattatctgcaacttcttctctcttgcctctagccttgtacccactcaagcctcttaagtcaattattcttcaggtagactcttgctttctgtccccactagtttccatgttggcagctcatgctggatcatcctgtcccatgccctgcctctaggttttctcccctccacactcaatagacgtgtggataatacacactgcagagaacctgccttagacatctctaggctccccactgcactcagcacaatgccttttgaaacacagacactcaacaaatgttcatataatgaatgcataaatagaggtgcaccaggcagcaacctcttctgaagcaagagtggtaaccgagataggaaaatattgcaatcgcaatttacaaatgctcttctgctgaaaatgaacaagaagattaagctataaatactctttcggggtaattaaatggaacaaaaggtaataattgttagcataaaatgcaatcacattttaatagattctgaaaattaaacaggctttctggcgatagatcttaaagcatttctattacacttattagagaacattaatttctgaagacccagaaatgacccagtcctttgaattacattgatgttattaccacacagcctgaaaattgtatatttggtattaagaaatcaaacacagtcactcttaaactttagatgttatttggtctgacatttgattttacctcacttacttagaaagtaagttactttgctactgtattatgaatcctgacggaagacacaagactcttgggacagaggtaaaggattttattattcacaacactgcaaatggcatgaatgcattggttcccttactctttaagtcccaaaaggatgaatagcccagaaggatgcctacataaggaatgtgttgtgctaaaggaactgacttgaggaactctgaaaagagcccagatggaggcattatacattctttaagattgttcactaaaaacacaacccagagaaatggctcaggtgaagaggttcagcaccctgcattcttttttccccccatatatacctctgtaagcaaagggccttgaattcttgatagacacaacaaggacctgcagggatgtgaagagccatggtgaattgcctctcccaacatacctcagataagaattaatactcaaagtaacaaggatatcattattagctttctgaatttagagtatggactattgggacattgatgaacatcatttgtgcaaaaataaactaggtgatcagaaagattaatacttattagttatgtgtgtgtatatatataacacacacacatatatatatatatacacacacacatatatatatacagagtgtgaggaaaggaagatataagttgtaacttgatatttttcaacagaatttttttttatgaacacatcataatgagccaaatgaaattctctcactttagcacaaaacttgagacctttgaaaaaatctctttcatgctatgtatgcttattctgaaaagcccatggctattctgctgcagcagaatctgacatgatctcaattattatcactaacagcattaatttatggaactatttactgtgtgatgcactttatgttagtgatgcacattcaaaagagaatagtccttgtcctcagaagacatacaacggattttggtcagcatgattagtcacaggtcccatcgtctattttagtatatctgagcataaggaaatatattgaagcagacttgtagttatggaatctctgaaaaggcctgagaaccaggcagggatgctgcatctccagagaatacgcaatgaggagcaacccagccagaagtcacactgcgtggaggtctgaaagagcaacacagcagctatggcccgtggattggcacctatggtgctcaggaccagacccttgacccctgccatactgccccagaaacctaggtgcctgtgccgctgtgcccgtcagaagcttctcccacggtgactgcttcctccattttgtcacttctgttgctaagttgctcacagcgaagccggattacagaagctagggcttgtttcgaacctaccaacagaggactcaggggaactgaaatttagctttatagtctatgtaatacagaaagataggctaggagggcgagcagaaaaggtgagcctattccacctatggtttctgccatcaggtagtatatacaagtagtaaatagtaggtagctattaaatggttgcaaaagaaaggactgcagtaatgtacatagatgcttaatgaatgtgtatagatcatcactgtccaatagaaacatgacataagccaaaactgattttacgttctctactaaccatgcaaaaaagcaaaaaacaaaaaaaggtgaaattaattttatcagtataattatttaacccagcatatccagaatgttattattttaacatgaaatcaatattagaattaataaagtgttttacattctttttgaatactaagttcaaatctggtttgcattttttccttatagcacctctaaatttccatgagtacatttcaagtgctttgcagtcttgtggggctagtggctaccacgctggatggcatggctctaaatggacagtgttagaggagcttagagatagggaatcagtcagatccagggtagctgagcagagcttcttggaaaagtgggacttgaatcatcttaatgttagaacttacaaaactttgaaaatggacaagagcatgccaagtgtcaagtctggatatttccagaggtcctgaaaagcttcagctactaattgtccttgctggatttttcatggttgaaatctgaccctgagaaacctgagtgtagggacatggtgagttcttctcatggaggtgaatatctaggagccagcctcagaatattgacatatgaaatcaaagggccattcttcaatttcaagtttttattttaggataattgtagattgacatgtaagtgtaaaaaataactacaggaaaatccacataccctttatccagtttcactcaatggtaacatgttgtaaagctatagaacaatgtcacaaccaggatattgacacttacacagtcaagatacacagcagttccatcatacacaatcctcatattctgctcccccaccacttttattttttgagacagaatctcgttctgtcaagtagctaggattacagtcatccaccaccatgcccagctacatttttgtatttttagtagagacggggtttctctgtgttagccaggatggtcttgatctccagacctcatgatccacctgcctcggtctcccaaagtgttgggattacaggcatgagccatcgctcccggccccaagttccccttttatagccacacctacttcccatctgctcccagcctccccctctttttaaaatgtttgtcaaccagtaatcagttctatagttttctcatttcaagtatgttacatatggaatcatacagtatgtaacctttggagactggctccttactcagcataaattttgtagattcatccaggttgtagaatctatcaacagtttgttcctttttgttgctgactggtatttccattgtatagactgtgaacattgtcagaatcaaaatggagttactcatgttaaaaaaaaaagtccaaccttggactggcattaccattgttattgatctttatagcaagaataatcatttcaaaacaattatgttattctcctcatttttcctttaaaaacctttgtcattctttacttccctgaatacacacatagttaactatggtaactgtattcccatcacaaggctctagtcccaaataaacatcattttctttcagaaagcatctctctgtttgttatttatgttgacataaatggtgttcagaagtgggacctagagtaggatcccatttggatgagtcagagattcttggaaccagtttgcagtacttgagcctctctgcttccatggctctctgcttccatggctcacctttcctgtcctggagagtcttctctcagccgaggagtcctcttttgggtagaagctcttgactttgtctgcatgaggccaccttactaaagaaccatacattcctcctgggatgataaaagactttttgtcttttctggtaagtcttttctgatataaagacaagtgtcctctgggttgagcactcttgtttctataatttacattttgtctgtgaggcatggcatttctggtgaattcacttttggttatgtacctagattaaaattttggttaatttgaaagcctgggttaacatttttgtgaacactattatcttggtttcttttgatttggtttgactcttctcctttgcttgtttccacaaattttctgagagtaatcataaacatagtaaatggtgggcacaagatggctaattaaaagccactaggtggttgactccctctaaaacactggtccaaactcctgaggtcctctgacaggatttataggattttctttgcttttgtgaagttaataagaaatggaatgggattctcaaacattaaggcatgccaggtttcctgggactccagccagctacatattatggcctgttcttcccattttaaaactgatgggcaaaattacatcaagaaaaattcagagctcaaatggccattattcaaattctctaaaaaacttctaactatagagttggtattgtgatttcatgactaaaattctaaaattaaaggtataagatctttgtgcatatgtataaatgtttaggtgtgtttatgcacatatacatgtgttatgttatgtgttgtatctacatggtaaaatctggcacagccagaaatgctctaggaattttatttagattggcttaggtaaataaatactcatataaaatatatagtaattaacccaaaatggctctttagcttacgtgacttaagctggctttaaaattattaacaagatagaaatatcttcagaattgtctgcatacagttttgctggtcatgtggctttatattagtttctgttggatgttgacacacagatgatgaaactgtaaacccagcctaaacagaatgacctttccttttgcaatttttttgatacttaagactaatttaatattgttgttttaatgaaaacaactgtatcttccgagttattggcaaaatgtccatctatttaactttaaagtttttacttagatgaacacctgatattcacaggctctaaagatggttaacagaaataattccaaacgatgactagctttgtttaatatctcagtttccacaagtaatctaggtaaactattaaaaataaataaatcaggtaaatgtaaatggtataagcatttataagtaaactttttatgtaattaaaaaatttaaagctctgttgcgttaaattacgtaataaatactcattaaatgtctaggtcatttcgaaataagataaaaacgaaaacaaattggtgatcataaataagtttgatttttgtccctgagattttatataaagactaaatatatttagatctattaatacttacatttagatctaagtatatttggatgaagtattttgaaccctttgacatctttggaaagcttctccaggattaaaattctaagtgaagcctgttacacctaaaattaactttgggcccctggagagcctcaaagaatgtgtctctcattttgcagcgatattaaatgattagacttatttggtaaattgtatgggaagcattgtcaaatgataagcgatactagatcttctttcagttacacttatggatatattactgatataatgtttcaaaaatttttatataaattcataaaaatctaatatgttatcagtcataattttagttgttaatgttaaatcttttttcaaaatgatatttttatggatatgttatttatgtgaatatcctaaagattacataaaatgtataagtctgatggtcctaatgtgacattgtcagtcataattctgattatctttatgccacaggtaataaaaataactaaatttcattgtaagtgtgaactttgatcagtttttttatcatagtatcttcagttattgttatccacagttactgttttgaattcttctttaaatggctttgtaatcagctatagtccaaaattgcttttcatggagaagtctaacaagtaccctcgaacaccgatttctggtaatgttaagatcaatggatgaaataaaaatattcagaactgtaatatagaaactgatcaagcaaaataaaatttaattacatgaaatcaaataactgattaagatcttgtttttttttttttttgagatggagttttgctctgtcacccaggctggagtgcagtggcaatatctcagctcactgcaaactccgcctcctgggttcaagtgattctccttcctcagcgtcctgagtagctgggattacaggcatccaccaccatgcctggctaatttttgtatttttagtagagacggagtttcaccatgttgtccaggctggtctcgaactcctgacctcaggtgatctgctctcctcagcctcccaaagtgctgggattataggcgtgagccactgtgcctaaccaagatcatgtttttatgatttttattcaaaacatggttggttctttatttaaatgtattgtttcccagatttaaggatttttttcttcttaagctgtttatagtttacaacaatttggtaaagtatagttttgtgaacaaaggtggaatcaatttttttcacatttctttaatatttactttaggtttaggggtacatgtgcaggtttgttatacaggtaaatcacatgtcatgggagtttggtgtacagattatttcatcacccaggtaacaaacatagtgcctcataggtagtttatcaaccgccaccctcctctcaccctctatcctcaagtaggttccgttgtctgttgttcccttctttgtgtttatatgttctcaatgtttagctcccacttataagtaggaacatgcagtatttggttttctgttcctacattaattagcttgggataatgacctccagttccattcatgttgctgcaaaggacatgaccttggtttttttatggctgtgtagtattttatggtgcatacgtaccacgttttcttcacctagtctattgttgatgggcatttaggttggttctatgtctttactgttgtcaatagtgctgtaataaatatacacatgcatgtgtctttatggtaaaacaatttctatttctttgagtatgtacccagtaatgggattgctgggttgaacagtagttctgttttaagttatttgaggaatctccacacttatttcttgttctgtggtctcagagcattggaggtatgatttcatttttttttttttaaatttactgaggattgtttaacgagccaattctgtggttgattttagagtatgtgccatgtgcagatgagaagaatgcatattctgttgttttggagtggagagttctgtagatgtctcttagggtccatttggtcaaatgtagagttcaggtcccgaatatctttgttagttttctgcctcagtgatctaatactatcagtggtgttgaagtctcccactattattgtgtgattatctaagtctctttgtagatctctaagaacttgctttatgaatctgggttctcctgtgttgggtgcatatgtattcaggatagttaggccttcatcttgaattgaacctttactgtgatgtaatgcccttctttgtctttttagatcattgctggtttaaagtctgttttgtctgaaattagaatagcaacccttgcttttttctctcttccatttgcttgctagatttttctccatccatttacttggagccaaaatgtgtcattgcatgtgagatgagtctcttgaaaacagcatagagttgggtcttgcttgtttacccaacttaccaatctgtgccttttaattggagacatttaatctgtttacattcaaggttaatattgatatgtatggatttgatcctgtcttcatgttgttagctggtgattattgcagacttgattgcgtggttgctttatagtatcaatggtatgtatacttaagtgtgtttttgtgggggcttgtgatggtcttttctttccatatttagcacttacttcaggacctcttgtaaggcagggctggtggtaatgaattctcttaggcatttgcttgtctgaaaataatcttatttcttctttgcttatgaagtttagtttggctggatataaaattcttggctggaatttctttaagaatgttgaatataggccctgaatcttttctggcttgtagggtttctagatctgctgttagtctgatggagttccctttgtaggtgacctgtcccttctctctagctgcctttaacatattttgctttcatttcaaactgggagaatctgatgactatgtgtctaaggaatggtcatcttgtatagtatcttgcagggttctctgcattttctgaatttgaatgttggcctctctagcaaggttggggaaattttcatggatgatatcctgaaaaatgtttcccaagttgcttgctttctttccctctctttcagagacaccgctgagacatagatttggtctctctctctctttttttttttttttaaataaatggtcgttttacataattccatgttttacagaggttttgtttatccttctttaatcttttttctttatttttgtctgactgttacttcagagaactgatcttagagcactgacattctttccttggcttggtcaattctgctgttaatatttgcaactgtattctgaaattcttgaagtgagttttcagctatatcagatcattttggttctttcttacaatggccattttatctttcatctcctataccattttatcgtatgccttagaatccttgaattgggtttcaactttctcctgaatctcaatgatctttgttcttgtccatattctgaattctatttctgtcatttgagccatttaagcctggttaagaaccattgctagagaactagtgcacttgtttggaggcaaacagacaccctagctctttgagttgccagagttcttgagctggttttttaaatctgcatgggctgatgttcctacaatctttgaagttgctgtactttggatgagtttttcttttcacttttttcttctttgattctcttggggtttgattggtataaagtggtacaaggtaggttcagtcaactggctttgtttctcttccccaagagtcactgaaggccaggaacaagttccagtgcacagcagccctgtgcagggttcccagcttcctcttccttcaggccagcatgtgtgtcctgccactgtccactctcaataatttgattttcttccctacttgatttttccaaaattcagaaactattcatgagtacgcttatttttatgacaatatgattatttacataagtttaataaagatttggtctctatattaatacacagttggaaacattgattatatttccaaagcttcagctaaaataacgtatttgagaatgaacataaaatgcctggcttcaagtattccagtcttatagtgaatgagtaagaattgtcactttctgccagacccagaaaccttaagaatgttagtaaaatcagtttcctagccccaagaagttttaaaatctgagattcctatgtgattggcataggaaaaaaagtcatgtttcaaagaaaaactatagtaccctgttaatagatagtagctctgttttgcattgtgcattgttttcaagttcttattgtctacctgtagactggacttaatcctgaattctcctaatttcctccaatacttggctacagctctccaactaaaatcaaaggttgttatgttcttaaagtcttataagctgaaactagataaatcttaaaaaacaagtctcatgcttgatgtatgggccacacagcaagttcattcataaaactacctgatgccatagaagagagagttgaaatgcaaaccaggagtagtagttagcgttttcacattatagaccactttttttcacgacactggaacaagacttcatgtcattatgagactcttatccttttaatgctacctttttcatttggcagtataatggtataattgaaatcttataatcaataacacctgctggtaactgaacagaacctcacctaagaaattatttagcatccattgttaaataagaaaacgtctatgctattactaacactacatgctatacctgaataaattcctctgtggaagttgagacctatatacacaaaataagaaaacaggtcacaaagttaacaagggtctcacttaattctttatggtcgtttgatttattcagttgtcttaaagcctaggcttatggctgaaaaccattatgcaactggggttgtcatgttactattgattttactttgtttatccgctttttaaactttgtatctgctatttgttaaatttttacggaagtacaactcctaaaagaataatactggcgcagtactttgaggtgataacaaaaagctatgaagcagacaaaattgaacttaataatgaactgcaagcagacagcctgagagccactccttcaaacctcccttgttgttcaactgtgactacatgggttttgaccctgactcctagtcaccaatcacttccatcaacatgccatgagaccagtagctgagacaggtccctcctggcaccgatggaaatcaaaacctaactacagaatgattaatagtgatgcttttggaaaaagatcttgatcaaatgagagaaacatgaaaattgttagaatcaaaatgaagccacaatgttaaaagaaaacccagataaatagagctcgggaaggtaatgaaaagagggttctcatgcttgtatacccaactaaaaaaaaaaaacctatcacaaaagactgcaaaaccgcaaccctgcacaaagaacatcataatcttacacacaaaaaaatacttctgcaaggtcgttttctcagcaactgcctgtccagacttggactggcatcacccttgttattgatcttcataaccaaggatagtcatttcaaaacagttatataatcctcctcattttttctttaaaaatatttgtcttcctttacctctctggataggcacacagtttactatggcatgcatattcccattataatgcttcattcccaaatgaatattactttcttttagagagcctctctgttatacaggttgatcagatgtaccactctttcacccactgagggacgtttggctgatccaggctttggctgtggcaaataaagctgctacaaacgttgggtattggattttgagcaaacgtgttttcatttctttgattaaatacccaggagtataattgtttgactgtatggttgtggcatgtttagtttttaaagaaattgccaaactgttttctcgagtggctgtatcatttcacatttctgccatcaatatgtgagcgttctgatttctttgcatcctcatcagcatttggtgttgtcattattatttatttagccattagtatggtgtgtggcgatatctcattgtggttctaattttcatttccataatggctagagattttcaacacattttcatgtgattatttgccatctgcatatcctttttagtgaaatgtctctttgtttcttttagctactttctaattgggttatttgtttattttactgttgaattttgagagttctttatatattccagatactagtccttttttggatacatagtatgtaaatattttccccatctgtaatagcttgcatttttattatctttcacagtacaaaattttgaaattttgatgaagtccaacttaattttctttttagaaatcttgcttttggtgtccaaaaaccaggcactgcagctcatacctgtaatccagaatgctgtgaggctgaggtaggatgattgcttgatcccaggagtttgggaccagtctgggcaacatagcaagaccccatttctttaaaaaaaataaaaatataaaacgagaactctttattcagcactagattccaagatttgctcctatgttttattcttaaagatttgataatcttatgtgttatcttaagtaatccattttgagttaacttttgtattaggtgtgttgttgagttaaatgttcatattcttttgcctatggatgtccagttgttcccgtaccatgaattaaacagtctatctttcctccatgtcatttgctccattaaaccgtttttgaacctttatcaagatgttgtatatatctgtgtgggtccattttgagttcactgtttcattgatttatgtgtctatccatctgtcaacatcacagtcttggttgctgtggctaaataatatgtcttaaaattgagtagacggtttcctcctactttattctttttctcaaaattgttttagttattttagctcctgtgtattgtcatatatattttataataatcttgtctatatctacaaagcctcttaccaggatttagatagaaattgcattaaacctttatatcattttggggagggttgacttctttattgtgtttagctttattatccatgaacatggtttgtcaccccatttgtttagatcttctttcatcagtattatgtagttttaaatgcacaattcctgttcatgctttgtcagctttacaggaaagtattgtgttttgggacaattataaatggtattgtgttttaaattgtggtgtccctgtgtttattactaggatatataagtgtaattgctgctttgtatgtatcttatctcctgtgactctgcaaacctcacttatttcttctaggaggttttgttttagattccttggaattttttatgcagacatttatgtcatctgcaaatagggaaagtattatttcttccttctgatctatatgctttctatttcctattcttgcattgttgaacttactagaactcccagcattatggagaataggatggtgagagcagacatccttgccttgatcttatctcaggaaaaaagccttcagtattttagtgtaatgctaactgtaggtttttttgtgggtgcttttgatcaagttgaggaagtttctctctattcttatttttctgagagttttcattatgaaggtgtattaaattttgtcaaatttttctgcattcatcaatatgattatagcatttttccttagtcttaatctaataaattatattcattaactttcaaatactgaagaagactggcatctttgaataaagaccaattggtcatggtatatataaagttgtgataaaaaccacataccatataatttaccatcttaacaatttttaagtatacagttcagaagtgtaaagtatgtgaaacctgaaaatttaagacagatctcagttcatttaaaaagtttattttgccaaggttgaagatgtgccctcatgacacagcttcaggaggtcctgatgacgtgtgtccaaggtggtcagagcacagcttggttttaaacattttagggagacaagagacatcaatcaatatgtgtaagatgtacattggttcagtacagaaaggtgggacaacttgaggtgaaggcaggacacctcaaagcaggaatgggcttccaggtcataggtagataagagacaaatggttgcattcttttgagttactgattaacctctccaaataaggcaatcagatatgcatttatctcagtgatcagagaggtgactttgaatagaatgggaggcagatttgccctaagcagttcccagtttgacttttccctttaacttagtgattttgagggcccgagatttattttcacttcaaaagtatattcatattattgtgaaacaaatctctagaacatttccattttgtaaatttgaaactctataccccttaaacaacaactcccttttcccctctcccagctgcctctcatgatcatcattacacttttgtttcatgaatttgaccactttatgtacctcatataagtggaatcatacagtatgttacaatttatttcacttggcacaatggcctcaaagttcatttacgttgtagcatatgacaggattgccttcctttcttctcagctttattaagatataattgacaaataaaaattaatatatttaaggtgtacaacttgatgttttgacatacatatacattgtacaataatcatcaaaattaagcaattaacatatcgattccctcacacagttaccattttcttccccccctttctttttgccacacttaagatctatactcttagcaaatttcatacatacaatacaatatcgctaactatagtcatactgctgtacattacatctccagaacttattcatcttgcataactaaaactttgtactccttgaccaagattctcttccttttaaaatctgaataacattccatggtatgtgtatgttataagagttaaagaaagaggaaagacgcacgaaaagtggctcaacagtcaaagacaaagacagatttattttggagaataaacctgaaaggggcttctggctgatattttttttggtcaggaacactctctcttacagactaaagtatttattggtgagagagcttggaatgtttctgtgttgggaagaagtttatggtggggttggaatgtctctggttggaggggacattatcttggggctgacatctctctggctggaggaaaggttatctgggggttggcatgtctctggttggggaggggtttggaatgtttctggtcggagatgttatttgtggtttatggtcacgccgaccttagccattaggctgatgccctttgggtttaggcagtttttgatcaaggtgaacttcagaatggtggtggttgtctaagatggtgatggtgatgctcctgctctgtcatatgtcacagccacattttatttatccattcatctgccaatggacatttgggttgcttccaccttttggctattgtgactagtactgttttgcacagggatgcgcaagtatctcttccgagatcctgcttttaattctttctgatttatacccagaagtgggattgctgggtcatatgacagttctattttttttttttgaggagcctccatactttttaatcaaccatttaacaatcccagcaacagtgaacaattctaatttctctacatcttcaccaacactttttattttctgtctttttgatagtattcatgctaataggtgtgaggagatatatcattatggttctgttttgcagatttgcatttctctgatgattggtgatgttgagcatatttttactttctttttttttgtttttaactttttttttttttttctgagacagagtcatactctatcatccaggctggagtgcaatgttgcaatctcagctcactgcaacctcccctgcctgagttcaagagattctcctgcctcagccttccaagtagctgggattacaggcatgtgctgccgcaaccagctaatatttttagtagagatggggtttctccatgttggccaggctggtctcaaattcctggcctcaagtgatctgcctacctcggcctccccaagtgctgggattacaggtgtaagccattgcaccaggccatgtatatcatctttggagaactgtctattcaagtcatttgcccattttctaaatggattatttttattgttgtggttgagttgtaggagttcttcatatgtactgaatattaaccccttatcagatatataatttgcaagtattttcttccatttggtaggttgccttctcaccttgttaatgtgtcctttgatgcaaaaaacttttaaaatttgatgtactatcatttgtctttttttcttttattctttgtgcatttggtctcatatccaagaaatcattgccaagtccaatgtcatgaaatttctttctgatttcttttaggaatttcatagttttaggcctttaatctacttttaggtaatttttatatgtggtacaagggcccaattttatttttattttttgcatgtggatataattcttacatattactgaatcctctttgctaataacttattgataatttttgtatttatatttataaagaggtattaatctatagttttcaccttttctattatctttgctttttgtctgagcaatactaactttaaaaatttaattgagatgtgttaattcctcttctattttctatttaattcacaaagctagtttgtagaattagtgttaattcttctttagatttttggtacaatacaccagtgaaacaacctgggcttcaatttttttcagactttcaaaaataagatttaaattcctttaatagtttcaggttattcaaattatttatttcacactgggtgagttgtgttagtttgtgtttttgaggaagttttatctaagttgtctgcagaagtgtttatagaattcccttattgtcctcttgatgtattcagagcttatagtgctatctcctgtttcattcctgtgattagttatttgtgtcttctatttttgccagtcctgctagagatttgtgaattttattgatcttttctaagaagcagctctttttttttccattcattttctttgctgtctttgtatttccaatttcatcagtttatgttttcatttttattgtttatttcatttgacattccttatgcttattttgctcatcttcttttagattcttgaggtgggagtttagattctcaagttgagatttttgcttcacttggaggagaaggaaagtctattttttaatctgtatttttgcaaaccgtgttcttcctttcccatgtccttttattggttgccttgtatttaggaaactttctttggtcttcttttagggtaagtctgttggcaacaaattctctcagtttttcttcatctgagaatgcctattttttctcttaattcccaaagaaaactttcactggatatagaatattggttcttttctttttgtacttgaaaaatgttgtgcacgttcatcatttctgatgagaaatttgctgtcatcggaattgtttttcccataggtagggagtaatttctctctttctgctttaaagatttgttctttgccttttgttttaagagtttgagtatgatgtgtcttggtgttgatattttgaatctatccttttctcaggttcactcagctttttgactttgtagtatatgtctattgccaaatttttgaagtttttaccactattttttgagtacacttatagctctgtcccctccttttgggactatgatgccaagaatgttagggtttttttttgttattgagctacaggtctttgacgctctggtgcccccaactcccagcagattttctgttatttagactagataattttgattgtttgtctttcaattcactgattctttccttttctcttccattctgctgctgagcccatccattgatgttttaaaatttctatttaaacatccattgagttttaaaatttcaattattatgtttttcaattctgaaatttttatacggctcttctttatttctttgctgagactttcttttttcctgtttatttccagctccttaaggcatttttatcatggttattttaacacattttcagttaattctaacctttctgtcttcttagtgttggcattactggttgtctctttttcattcagttaaaattttcttggtttttggtgcgatgagtgatttcttaactgaaacttagacattttgcttattatgctatgagattctggatcttatttaaaccttatctgtaagctggcttcctttgacactatgtttctcattaaaggggcaccaccttgttactgccaggtgggaatagaagtccaggtttcctactcagcctccatgttgacagctgttttgggtttgttactgaacagaactggagtctgctcacctgttgcagtcaagtcaaacatccatactgaggctttgcagcagaagaaaggagaacatttatttgcagggcaccaagggaggagaatcagaccactcatacttaagacccaatttctccaatggcttataagctagagtttttaaaggcaggagtaaatttcaggaaagcagaaataataggcaaacatataaattaatacatggaggttatacattgcttttccctaaaaggcaggataccttgaagcagggaggcttacagatgggttcaaagactctttgatttgaaattagtttaaaaactaaagctttgtctaaaaacttggggtcagcagaaaggaatattgagctctggcctgcgggtgtgacttcttctaggcatctcaagaagaaatttagaacaaagacagaggtcagaattctgtcctcagctcccccttatctgaggtctacctgccagtggatccatttggtgggggctcggggtttctaaaaagcaatccaggaacatatgttaagatgctatctttagtttctataggaaatcatacatctttttactctttcttggctatagtttttttttgtttgtttgtttgttttttttgatggagtctcactctgtcgcccaggttggagtgcactggtgtgatctcagctcttcaaacaatgttcctgcctcagtctcctgcgtagctgggactgcaggcacccaccaccctgcccagctaatttttatgtttttagtagagacggggtttcactatgttggtcatgctggtctcaaactccccacctcaggtgatctgcccacctcggcctcccaaagttctgggattacaggtatgagccaccgtgcccagcccttggctattgttttaagttactgttaccttcttgcttatcaggtttctcatttacttctcagggatagctaggtgcctggaatctcccttgaaggaaactcaaaaattttccttatttccatatttgggtggcctggaggcctctaagagggattctagttccatctgaagttcattgtaactgctgggaagaggtgggggttctggccccaacactgataactccttggctgggaagggtagtggtgccttttcactctttcccatgtagactccactgacacacagtgaaggggcggcctccttccccttgggcagtggtgagagtcttggtctccattaggcctctaccaccaccccaagaggagggagcaggcccctcagggatgaatgtcctggctccatactcctccttctctgaggccacccttgcagggctgggtgggctggagcacactgttgcagcctggtgaaggtggaagtccaggctctcctcttggcctttgctggtggggtgtgggtggagctacggattttttctttggcatttggctgtgtcagagcagttgtcatctaaaggttttctactcctttcccagtcgtttgattagagacaataggtttttcttgagcctttttttcttgtctgtgcccatgggcatttttggattgccagctcctctagtattcggtctgggagagatgaagaggaagaaaatgcagggaactccctaccatgttgttcctcatgtcctaagacctcttctcagtctgttttctactgtcttttaggttttccttaggtttattttacataatgtccaaggcttttagatgtgcttggtgggaggaatagggaaaagtatgtctattttatattctaagcttaagggccaattttaaaattttctgacaaaaatgtaattgtcatggaaaccaggaagtctagtttgcattatcactgatagcatagactcttcctatagtttgtcttatgtgggaggacaaattacattcaggaggttgttgggtgagtctggaatcggggcacatattataagattaacatgtaaattttaatggccctagactgacacaaccatctcatcaatcgagatattatcatcaacttttgcatctttcttctgcactcatcaagagctaatatagcgtagtgaataagagtgtggactggggccagactggcaagtcttgagtcctgactttgcctcttattaacttggtggccttaggcaagtgatttagcatctcgttttcctcatatgtgaaataaacaacaaccaaagtacctgttacacagggttgctttaaaatgaaatagttaaagcctgtaaagcattcagggaagtatttggcatgtgccaaacactcaataaatgttaactcttattagtgcctaataagtttcctgaaagacaagattgtgtattgaatatgtaaattgagtcacatgatggccaattcttgttacacttcagtttctttagggtgtctttgcctctgtcttctcggattcatttgtgttggtttcagggtggaatacttagaaaaccatctaactttcctcactgaggagtcctcacattgcatctatcacaaagctcctgtgcactaacaataattcttcgaagagttgctgagtgcagagggcattccagtgtaggcgatgtgagaaaggttgcaggtgtgggtgagctggcggtgcaggcgctgacaggcagacgccaatgggtcagttcgaatggaaagggtggtgtgaaataggaagggcaagattatctcaagtcttgaatttcaggttaagaaatttgggttttggttttttaacaattggaaaactgtaaattggtctagagcaggaattcttaatctttttgtgtgttgttatgtcatttggcaatctaacaaagttcacagaccccttctaagaaaaatgaaataaaatgaaaatgaagtaaaatacataaaaggaaatacatagaattataaaggaaataaatataatggaataaagttttaaatattaaaaaataactgtgtggtaaatacatatactttcatattacaacagtgaataagatctattaactactataatttcacccttaagtgatatgaaaatgtatgtgatttctattgatgggaaagccacaggtactgatactactactatggtttattgcctactttcacaactaaatgaaatgcaaagtttcagccacagtttagtgaaaattaagttttctgtttttctttcccatctaagtttatgactgttgttgacaaaaaagccaaacactgtaaaatgcttaaagaggtctattctgagccaaatatgagtgactatggccctgggtatagcaataagaggtcctaagaacatgtgcctgaagtgatcagtttacaacttggttttatacaatttagggagaaagaagttataggcaaagatgtaaatcaatacgtgttacatgtaaggtatgcatacgttggttgggcctggaatgaagggacatctcaaagtgtgggggtgcttacaggtaacaggtggatttaaagattttttggttggcaattgattgaaagagttgagctttgccaaaagagttcaagtcactaaaaagaaatgcttaagttaagataaggggagttgtggaagccatggttcttgttatttggatgaagcctctaagtagtaggtttgtattagtccattctcacgctgctatgaaggcatacctgagactggataacttataaaggagaggggtttaattgactcacagttccacatgctggggaggcctcagaaaacttagaatcccggcggaaagggaagcaaacacatcctttttcacatgacagcaggaaagagaagaatgagagccaagtgaaggagaagccccttataaaaccatcagatctcgtaagaacttattatcaggagaatagcatgtggaaaaccacccccatgattcaattacctcccactgggaacctcccactgggtccctcccaccacatatggggattatgggaactacaattcaaggtaagatttgggtggaaacacagccaaaccatattaaggcttcagagggaatagatggtaaatgtctctttttggaccttaaatggtgtcagacccttagttaaatctctcctgaatttggaaaagacctggaaagggagggagattctctacagatgcaagtatcccttgcaacagacagcatttgcagggtcatttcaaaatacttcaatgaaatacattttggggtaaaatactttgattttcttgagaccttgctattgatcaggtgatgctataccagagatggaatttgatgtcttcttgtcacaaagagtctgtctggtgagtctttaatctcagttttaatgttaattctggtctcgtgcctaaactccaaaaggcagggagtttataatgaagcatgtcagacctcgcctcccatcatggtctggaattcagttttttagctttcccttggcccagagagggtccatgcagtttgttaaggggtttacaattttattttggtttacactatggatcatatccatggagttcttgcgattttgtgggcctccagttaaaaactctggtctgtatgtgatttggtttggcatgttgtggctcatgaagcctgtaaaacagtgcagatatgaccactgtcaatgtttgccatgcagcaatctcagcagctacctcgttgcctcacaaatggaagaacttaaaaaatttggaaagtaaagagagcatgatgccatctctgatttggatgcaagcaggcagtaaggcacaaataacaaacaaatgtgaaagtctttatgtaatatttttgatcgtttcattaggcatttgttttcttaattttttaaacacatcaaatttaaagatagagaacaaagggataaaactataggactcaagaagcagcactaaagcatataatctgtttatactagaactaaaataatctcatcaataattggctgttaactccatgcttgtcacttagagaggaggaaaaacaaaagggtatattctgaaacacagatcgagcaagtaaattattgagtgattcacagtaagttgacatccctagctgttgcctggacactcagattctaaattgatggtgaccattccctggtgactcagaaaacttaaataaaaacagaatcaagcaaatctagccaagttgagggtccaccttctcctaaaagattgtttacttgtttatttaagacatcaattctcaggctctatctctcccttccatggcactaactctcacttgaaccaacagtagctaagtacacagaaccaaataaaggtggcaaagttatttagaagccaggggaataaaattgtctaatgcaatagtctgtacatatatgtatttgctatttacataagcttataattttcatcatcatcatcagtattgttgaagggctatttttagctgaatttttaatttttgtgaatctgctaggtaaaatcacgttttatgattagcagcaacgttgaagccatccaagtttcttctgctgcaaattatcttttattctttgttgagatttcaattgtgttctaaaatattttttcttttatttgcagaaagacatttttatatatttgctttttacattttaagatagctgtttattagtatttgtggtctttttacatttaattcctgggaacatgttttactgctttgcataacatatactttttgaaatatagttattttttaactgattttattcctgatatccccaattaattatagacataatatttattcctctgatagtcagttttccaagagacactggtttctaagaatgactaagttttaaaacttttgattagagaatcacaaatgaataaacataatttgaaatctctattatcactaaatctttttctagatgtaaagtatatagttagtaaaaagataatacatagtttaaactaatatttaaaataaattgtatgtgtgtatgcaaatatgaagagaaaatatattagatttttaatataacagctttactgagataaaatttataaaccatacaattcacacatttaaggtgtataattaaatagtttatagtatattcacagagatgtgcaaccattgctcactcaattttgaaacatttttaccatccctagacaggaatttcttaataatgtgatccagtagtagtcacaatctattcttgacaattactaattcactttctgtctctatagatttgcctattctggaaatttcataaatggaatcgtataatatatggtcttttgtaactgacttccgtcacttagcaaagttttttcaaggtctatctatgttttaacatgtatcagtgtttcattccttttttattgctaaataatcatcaatcagttgatggacatttgagccttttctacctgactatcaaaattaatgctataacattgctctaaaagtttttatgtggacatagtaattttccttggggagatagctaaaattgcttaaccttttaagtaactatcagactgttttctaaagcagctgtaccattttatgtccccaccagcagtgtgtgagggtttcactttatatcctcaacagtgtttgttatcatctttttaccaatagccatcatagtgggtatgaagtggtacctcactgtggtttttatttgtattaccctgatgactaatgatgtcgagcatctcttcatgtgcttgtgagccttattatatttggacaaacgtttattcaaaccttttgcccatttttaaattgggttatcttattgaatcaaagagttcttcgtatattctaaattaaagtctcttatcagatatatggtttgcaaaatatcttcttgtgtgtattgttttcactttcttaatgatattcattgaagcataggagttttaaattttgatgaagttaaatttatttattttttcttttgttgcttctgcttttggtatcatagctatgaaaccactgcttaacccaagttctccaagatttatatctacattttctccaaggagtttttaaaattttaatactaatatttaggtctttgatccattttaagtcagtttctgatatgttatgatgtaggttacacagctgtcctaaccaaaactatttgattatagaaccaacaggttagtatgcttgctgcacagtaacagaccaattacacggagacagcagggcttgcagcagagaaagagtttaatgattgcagggtaccaagcaaggggattggaagagaccttcaaatccatctccctgaggagttctgggctgggaattttaaggggattgtagtgggtgaggggctagaaaattgggattgttgattagttgggttaagggggataaaatcatcaggacatggaaattgcattctttggtgagtcagccccttgtagggtttttcagatcatctggcatcagtggggtccttcagaccagctggcatcagttggtgcttcagatcagctggcattagtggataccttcagatcagctagcatcagtggggtccttcagaccagcttagtcagtagttacatcagtatgcaggacctgaggaatatctcaaaggaaaaatgtaaggttttataatgttcaaattgttatctatagaatagttaaagggaattatagtcttgtagtaaggtccacatgactctgaggcaatgtaaagactatatttacttctggattttaactgtatagttttaggttgaccatttgaactctgaattttccttgctgtaatttaatcatcagtttaaaaatgtgcagaagaatgggccattatatataaccagcttgagtcttagaaaatttgacatgcctttgaacttccccatagtttttcatggacgtttttgcccttagtgggtaagttacccattgcactgacctgatgaaggcattacttgtttccagttttgcaagatccaacccaatgagctgcttggaggaaccaaatcaacatttcccattccagccaagacaatgtgcatacaacaaaaaggcagacactagtcactctgctcagtgcccaagcagtttcatctggcaagcctctcagtttcccccagctggcctccagtgcctttggtctactccagattgggcagtataaccactgactggaagatcagcaggtagtttctgggcaagattgaaaagcagacagcctaaccctgagttagacctgctagcaattccttcagggatccctttctcaaacaaaaacatatacaacaagacaaagacaaacaaaaggtccaagtttcggaaattcctaaatcaaattccaagtttcagtgtcctttgttctccttccagtttagtgggaatcctctcaatcaaggtccttcttattactagggagtgtcgacaagacctcagaagaggccccaagaactccaattaattggccagctaattaggagaaaggaaatggggtgccggttgaccagagaaaacttatcaaagaggtctttcaaaacctgtttccttgatgttaacaattcatgtgccaaaggtcagcactgccctgtgaacaggcaagggaccagagacaggccccacttcaatggaactgagtggctttttgacttgtctctgggtctgtcccagtgatgagagggaaccaagcaacagggaaatgcccacaaggggctccagggtaggctcatcataatttgttataagatcaagaggtttatatgtctgctatgcagtaacagaccaatacgctgagccagcagggcttgcagcagagaaagagtttaataattacagggtggctgagggagaagatgggatgagacccccaaatccatctccctatggagtactgggctggttttttttgacaaagtctcactcagtcacccaggctggagtgcagtggcacaatctcagctcactgccacctctgtctcccaggttcaagtgattctcctgcctcagtctcccgagtagctgggattacaagtgtgtgccaccatgcctggctaatttctgtatttttagtagagatggggttttgccatgttggccaggctggtctcagactcccgacctcaagtgacccaccctccttggcctcccaaagtgctgggattataggtgtgtgccaccctgcccagcctgggttcagatttttaaggggaccatggagagtgagggctggataattggagttgtcaattggttggggaaagggggatgagataatcacgatgtggaaactgcattctttgatgagtcaactccttgtggggtccttcaggccagctggcatcattgaggtccttttgaccatctgaatcagtaggtgcatggttacacagcacctgaaggaaaatctcaaagggaaaacttaacatttcaaagtgttcaagttgttacctatagagcagttaaggggaactataatcttatgacaaggtctgtgtgattcaaggacaataggcaccaaacaactatgaggaaggcgtcagagagcaagctaacggtattagctcattctcacactgctataaagaactacctgtgactgggtaatttatgaagaaaagaggtttaattgactcatagttctttttctgggcggggggactgagtctcattctattgcccaggctggagtgcagtggtgcgatcttggctcactgcaacttctgcctcgcaggtccaagtgattctcctgtctcagcctcctgagtagctgggattatagacattcgctacattgcctggctaatttttgtgtttttcgtagggacagggtttcaccatgttggccaggctggtcttgagctcctgacctcaggtgatacgcctgcctcagcctcctaaagtatgggattacaggtgtgagccacgacacctggccaactcacagttctgcaggctgtacagtaagcatggctaggaggcttcaggaaacataatcatggtggaaggcaaaggggatgcaagcatgtctgatcatggcagagcaggagagagacagggggagagagagaaagaaggggggaagtgctacccactttcaaacaaccagatctcatgagaactctctcactgtcatgagaatagcaagggggaaatccaccccaatgacctgatcacctccctgcaggtcccttccctaacactggggattacaattcaacatgagatttgaatggtgacacagaggcaaattatatcattctgcctctggcccctctcaaatctcatgtccttctcacatttcaaaagcaatcatgccctcccaacagtcccccaaagtcttaactcattctagcattaactccaaagtccaagtccagatgctccaattccaaaagggagaaattggccaaaacaagggcgcaacaggccccatgcaagtccaaaacccagcagggcagtcattaaatcttaaagctccaaaataatctcctttgaaaccatttctcacacacaggccacactgatgcaagggatgggctccgaaggccttgggaagctctgaccctgtggttctgcagggtacagcacccccagttgttttcacaggctggtattgagtgcctgtagcttgtccaggtgcacagtgcaagctatgactccaccactgctgcagacttcggcgtggatatccaagtggttccatacattctctgaaatctaggcagaggctcccagttttcaactcttgccttctgcacaccagtagccctaacatcacatggaagccaccaagtcttggggcttgcactctttgaaacaatggcctgagctgtaccttggccccttttagccacagctagagctggagtgaccaggatgcagggtgccatgtcctgaggctgcacagagcagcagggtcctggggctggcccatgaaaccatttttccctgctaggcttccaggccagtgatcagaggggctgccacaaaggtctctgaaatgcactggagacattttctccattgccttggctattaacatttggctcctctttatttatgcatatttctgcagctttcttgaatttctccccagaaaatgggtttttctttttcttttctaccgcatggtcaggctgcaaattttccaaacttttacactcagcttcccttttaaatataaggtttttttgtttatgcaaatgagcatcagtttttaaaagcagtcaggccacatcttgaatgctttgctgcttagaagtttcttctaccagataccctaaaccatctctctcaagttcaaagttctgtagatccttagagcaggggcgcaatgtcagtagactctttgctaaagtagagcaagagtgacctttgcttcagttttcattaagttcctcatctccatctgagatcacctcagcctggacttcattgtccatattactatgagcattttggtcaaagccattcaacaagtctctcagaagttccaaacttttcctcatcttcctgtcctctgagccctccaaaatattccaacctctgcctgttacccagttccaaagttgcttccacattttcaggtatctttatagcaataacccacttctggtaccaattttctgtatttgtctgttttcacactgttataaataactatctgagactgggtaatttatgaagaaaagaggtttaattgactcgtgattctgcaggctataaaggaagtatggctggcaaacctcaggaaacttacaatcaggcagaaggtgaaggggaagcaagcatgtcttaccatggtggagcaggagtgagagagagagagagagaggagagagagagagagagaggagagagagagagagagagaagagagagagagagagagaacacaagcgaaggggaagtgctacacacttttaaacaaccaatcttgtgagaactcactcactgtcatgagaccagcatggggaaaatctgcccccatgatccaataacctcccactacgtccctcccctaacactgaggattacaattaacatgagatttggatggggacacagagccaaatcatatcactgacctaatgattaaggctgaatgtgctgcaaacttggtttagttttgtttctccccctcccttcttccctgattaactttataaagtttgaaggaccagtttcatattctttttctactgaaatatcttggcattcttgtggaaagttaattgaatgtaacaatttatttctggactctcaatttcattcctctgtatctttattcctataccaatatcacactgtcttgattactgtaggtttatagtaagttttaaaatctggcttaagtttaaaatctgactcttctaactgcattgttctgtttccagctttttctgtgtggcaactttcagtctcttgaatttccttataagctaaaatatgctgaccaattcctgcaaagaagccaactagaatttttatatggcttgcactgaatctgtaaatcaaatcagaaagtattgctatcttaataattttaagtctttcaactcatgaacataggatatcttttcatttatttaggttttttaaaaaaattttctttcaataacattttgtagttttcagaatacaaattttacacatactctgttaaatttatctaggtattttattctttttgtttgatataactcaagttgttttctcaattttttgaatagtttattgacaatgcatagaaatgcagttgatttttgtatattaattttgtatcctgaaatcttgctaaactagtttatttaagtatattccttaggattttctatatacaagattttgtcatctgcaaatagatagttttaccttttcctttataatctgataccttttatttatttttctttctttctttcttttttgcctaattgccaaggctaaaatcttaagtacaatgttgagttgatgtggcaatggtggacatccttatcttgttccttatcttagaaagaaatcgttcagtcttttgccattaagtatgatgtttgtgaactgtatggtggatggactttactaggttgggaaagtttcattttgttgatagtttgttgaatatttttatcatgaaatggtattggattttgccaaatgctgttttttagtctgttgagataatcatgtgctttttgctctttgttctattaatatggtatattacattaatgggtttttaaatgttatactaactttgcattcttgggataaatcccatttgttcatggtgaataatccttttagtttatctgttatcccaacacagttttgcttacactcaccttttttttcctgttattctaaattacattgctatatgttgtatgcccaacagtacaattatgtaagtattgtttatataattgattttgaaaattagttaagagaataaagaagtgttggaatattgtgaaatatatatatttggtcttcatccctgctccctggcatgcagcccctaaaatccttcgaatgtccaaagaaatgctttttgtatgctaatgattgactgatacctggcagccccttcaggatcccttcaggatcccttcaggataggggctgatcaccagagagaccaaggcaggattggagggttgggactttcagccctactccacaacttctgaggagaatagaaggttaatctgatcaccgatggccaatgatttaatcaatcatgtctatgtattgaagcccccataaaaacccccaaaacagggttcaaaaagtttccagatagttgaacacatggaggttcctggaggtggcacacccaattagggcatgaaagctgcacacccctccccccattcctaatcctatgcatctcttcatccatatactttataatatcctttataacaaaccagtaaatgtgtttccctgagttctgtgagccactctagcaaattaattaaacccaaagaggaggtcatgaagctgatcagtcagaaatctcagaggtttagacttgcagctgaagcggagcagttttgtgtgactgagccttcaacctgtgggatctgatgctattaatatccaggtagatagtgttaaacttgaattggtgaacacgtagctggtgtctggtgccagaacaattacttgcttagcgtgttgggagaaaccccacacatttggtcacagaagtcctctgtgttgaatgttgtagtgtgagagtagagcaaaaacaatttgagttttttccatacaagtgtttatattgttttatgtaattacatcattatctttactattgctctttgttttgtgtgtgtatcaatttgaattactgtctgtggtcacttgagtccagcttgaagaactttatttggtatttattgtaagatagttctcctagcaacacattcacttagtttttaaaaatctgggaatgtctttattttaccttcattttgaagcttagttttgctggatataaagattctttttgatattttttctttctgcatgttgaacatgtcataccactactttcttgcctccttgttttttgtaagacctcagccaataatcttactggagttcctttgtgtgtgaagagtcacttttttctattgttgccctaaaactgtctttatctttttttcttttgctttcaacaattttactatttgctttcaagttttactatgatgtgtttgggtctagatcccttttcatttatcctactgtaagttcattgagattcttgagtgtacaggttagcatttttcaactaatttggaaagttttcagtcattatttctgctattatttgaatgtgtttccttcaaattcaggtattgcaaatgtgataatattaaaaggtgggccctttcagagttgattagacctggaagaatcatctcaaattaatgggattgaggtccttataaaagggccttttggctcgagcttgtccttcctccctctgccatatgaggatgcagcaagaaggccctcaccaaccaaatactgatggcttgctcttggatttcccaggctccagagctgtgagaaatacatttctgttctttataaactaaccagtttcaggtagtaggtagcagcacaaaatggacaaagacaatttctttcaatattttttccctgatttatctcccttctctccttctggtcctcctgttatcatggttagtgacagtgctcagagtaagtgtaaatagtgagaagtgggccattaaaacaggatagttggagaaagagacctatctagatcagcggctagaatacagtgaatgctcaataaatgaatgtttgctgacttgaattaaattatcaaggaggagcccagttttcctttaccttttttcatcaatgtggctcttgacactattaagttctagggatgctacggccaaaatatggctattaaaaataagcacataaagcaggttttgagcaaattaatgacaagatattctagttaacacccttaaagtaaatgtgaagatacatacttaaatgtagtcacttaatggattagagatgaaaattctgcttgatatactctcttgattgcttgaaagctatttagaaggtcaatagataaccagtcaaaatctgatgaagagagcacgttttaccatctttgtacagagcagatatgttgtcgttaaactgatgaagaatctcattttccctttggaggcccggaagatggactcattaactttatttttaagaacctttttttcctttgtaaccttcagagaaatgccagcaattacagaaaaggcaaactcacagaccaagtgatctaaagactattaagtactgtggtctcaataacctttcgtagcataaaattgatcacaatgtaatataatactttaaatatatttcatatcatatgaattttactaataacttttaaaattaagaaaacttcacctgcctccttgcaaaaggagaatttaaaaatatgaaatcacttacccacctacaactatttgatcataattgaatacacagaaatacatatatcattgatcatttcaaaaagtcatacagtaaatactaaactgatattttagcatttataaaataaagtacatttttaccaatgaggtcattagaattttatgcaattttgctaatgtggtttgaattacttgtaccactttttgataaagcacatgggagcaaaatattttaaaaatatttggccgggcgtggtggctcatgcctgtaatcccagcactttgggatgctgaggtgggtggaccacaaagtcaagagatcgagaccatcctggctaacatggtgaaaccttgtctctactaaaaatacaaaaaaattagccgggtgtggtggtgggcacctgtagtcccagctagtcaggaggctgaggcaagagaatggcatgaaccaaggaggcagagcttgcagtgagccaagattgtgccactgtactccagcctgggcaacagagcaagactccatctcaaaaaaaaagaaaaatgtttatatgcacagaagtttcatcattaaaattagccctctcaggccagctgtggtggctcacacctgtaatctcagcactttgggaggcccaggcgggtggatcacttgaggccaggagtccaagaccaacctgactaacatggcaaaaccccatctctactgaaaatacaaaaattagctggacgtggtgacaagtgcctataatccctgctactctggaggctgaggcaggagaattgcttaaacctgggaggtggaagttgcagtgagccaagatcgcaccactgcactccagcctgggcaacagagcgagactgcgaaaaaacgaattagttctttctcaaataattttatttcttttcaacattttaaaaattaataaaaaacagaacaaaacagaacagagaatgaccaagaacgtgttagttgaaataacaatttgctgttaaaaaatacaattttatgttttgcaacaacaaagacattaatgcctgatgccattttgtaaattgtctattattctccttgaacttcatggggaaagaaaaaacttgatcaagttcacacaactggattttgtgtagaacaacactaaaaactgaatctcttatcctctgaattcgctattttttccccagtggattttattctcaacatgatccctgaaactcattctaaaacacatgcctaaaaactataaatgccttgctttgacctaatgacccctccctggctaatggatacaatcaaaaacccgcaacattgcatgaaggtccctcatcttctggccttcctctacttaaccccatctcttgcctctttcccattgatattcctactctctagtcacaccaaattccttccaattccctgcaccttcatgtattctcttgccatgatgcattttgctctctatgaaagtaatgccttcttctcctactttaagggtccttgtcctttgaggctctgtttaatcaatagcttggagaagctttttccagctcctcagttgcaagatttgagctcctacaggcattggaagtggttgctgaatgaatgaataaataaacaagctccaatattgtatcttcttttcataccattcacttaatcatgtgtgtgagtgtctgaatgattcatgcataaccatctttgtagaaaaaaatcaacaataatgttagcttgtgcccgtctttgtgtaccagcaagtgacttcactagaacgttcaactacctcatttaatgtgcacagctctcaaatgaggttggcactcttactatgcccattttaaagacgtggaaactgaggcttagaaatgttgagtgacttacccaaggtcatgtctaatgaagtcacctctgggaccagctctcaagtctgaccattaattacactgcttctacttttagcaacttctctcacaaccatgtggcttttctttctaccttggctgaagaatttgattaagcagggactgaatgcaaggagaaagtagctgttttcaatatcaaaaagtagatgatagatcataaaagtcaaattacaggaaagaggtagtgattcattaaattattttgcagttcaatttgtcaattcctcatgtacctttctctcttgataaccacaagtctctgctacaagtaacattaaaggcagagtaacgcatcccttcaaagttagtcccaatttgtgatgtcattatgtgatgttgtgggcccataccagcacatgacaaaatactctgagcttcaaatgatctgcttggctttagccaaagagttggaaagaaaaattacacaattgtaaccagaatgtcctcttcctcccctgctccccaaactggagccctgctgttgaatccctggcagaatgggttgcctgccaggtgcttgtcaaggttgctgagagatgatgaaagaaaagcatagaaatataatctgatttttttatcttttccctctataactcatatttgaatatatgattttcttccctcctcccccacaccctattttctagactaatcacaatgacatttggagaactttctggatgctttgtttgatgtatgttatgtgataaactatgtccttcccccaccccccaaattcctatgttgaagtcctaagcccagtatctcagaatgtgactgtctttcaagaggtcattaaggctagatgagctcatatgggtgggctccaatccaatatgactggtgtccttattggaagaggagattaggacacacagcaggaagaccatgtgaacacacagggagaaggcggccatctgcaagccaaggacagaggcctcagaagaaacaactctgccggcaccttgatcttcgacttccagcctccagaattgtgagaaaataaattaaatttctgttctttaagccccttagtctgtggtactttgttttggcacccctagcaaactaagatgatgtgcaaaagcagaaacattttctagacttatagcagaccttggggagatttctggattttttttgatgtatgaaagctgaactattttcaaatggctaagttaggatatgggtctcccctgaaaataattcttttaaccacctaggcaagaaatcctattctttacagaaaaatgacagccttgttctgtcgtagaacagtcagaacacatctggtaaacatgtttacctctgggcaccacacttaggagaggtgtagacaaaggaatatctagatggtaaaagaggtaaagcctatgttttattagttgaaggaattaggaagtttggtctagaaaggcaatgactcatgaggtggggatgagcactttttaagtatttaagtatttaagtatttaagtatttatgactacaactgcaaaatattgacaaagcaattaaagagaagaattttagttcaatataagaaaaatttatgaaagtcagacatttccaaagatgaaatgaccaacaaggaagtaacaagctctttctcttaggaagtggccagagggtagttgacaactcgtggtgggtattgtagaaaggatgttttcatcaggagaaaaaaacattctgattggaaaagtacttcaagcagaggcaattcaacacagagaatgagttaaaagcctgttgcaaagatggtggaggagcaaagcaggatggtaaggtcactcaaagttgagaaactccagggtcaccacgctgaggggcttgaggacctaatgggaagatggagttgcccagcgggaagatggagtgacccagcgggaagatgaagttgcccagtgggaagatggagttgcccagtgggaagatgaagttgcccagcgggaagatggggtggcccagcgggaagatgaagctgcccagcgggaagatggagtggcccagtgggaacatggctcagcgggaagatggtatgacccagcaggaagacggagttgcccagcgggaagaacgggttgcccagcaggaagacggagtgacccagcgggaagatggagtggcccagccggaagatggagtggcccagtgagaagatggtgtggcccagcgagaagatggggtttcccagtgggaagatgcggtggtccagcgggaagatggtgtagcccagcgcccaggacagttccgctgggcctgagctcggcgctctgtgccctgctggctcctgtggctgtgacatcactgcccaaagctgctacctccccagcccagtgctgggttgacagtaccaacaggaagacagctggcaaaagaggtatgtggtgcatgcgctgctgggctctaagcctagctgaggacagaagagaggctaaggactgagcgagcctagccaccacttcagcccagggtcagcgggcaggggcggggctcactggaagaatgtattttcttctgcagcactggaggtctttgagtctgtgaacttgatttaatacttttgcctccaatgggtcaaatctaaccttagtagttcctctccttccgtcttggagagagaaaggaaagcccggctttccgggactgagacacttaatgaagaggtcattgcctcccacctcctggtgccgtagttttgcagaaagccgctcctacccggattccgcctatttcctggactcagtccaggccgactcaagaaaggataaggggcaggacgtggtggctcacgcttgtaatcccagcactgtgggaggccgatgtgggcagatcacgaggtcaggagatcgagaccatcctggctaacacagtgaaaccccgtctctattaaaaatacaaaaaaaattagccgaaggtggtggcacgcgcctctagtcccagctactcgggaggctgaggtaggagaatcgcttgaacccgggaggtggaggttgcagtgagccgagatcgtgccactgcactccagcctggactacagagcgagactccgtctcaaaaaaaaaaaaaaaaaggataagaagggacgtattactatattactatagacccctgggtctttcctttccagttccaaattatttacttgtttcctcatttatttatttatttggtggtcaaaagtgcagcacctggaggatgctgcctgtttctgaactgcggttccggcacttaccagccttgtgaccttgggcacatcaagtgcccaagtttcctatctgtaaaatggagttgctgataatagcatctacttcataaagcttggttgaggccaggcacggtggctcacacctgtaatctcaacactttgggaggctgagacaggcggatcaccagaggtcaggagttggagaccagcctgaccaacatggtgaaaccccatctctacaaaagtacaaaaaaatttagccaggcatgaaggcagatgcctataatcccagcttctcgggaggttgtggtggaagaatcacttgaacctgggaggaggaggttgcagtgagccgagatcgtgccattgcactccagcctgggcaagagagcgagactctgtctcaaaataaataaataaataaataaataaatataagtaaataaagcttggttgaagattaaataaggtaatacacgtaaagcccaataactactaccaatcattagtgtcattactggtagcagaggaaaagccacccagactggtaaatcagcccttacagggcagtctgggatgggctgtgatggagtgagaggggcaggaccgcagagaaacatgcctctgggactgcggcctctaggaagccctcccagaagctggatgcccacggggttctgaaggaagggagtgtattggtgctaccgagggcacaggcatgcacaacaggctgcgtgctctgaggggctaaggcggatttggggaggaaacagcccctcccttttctcagggtccctaccagatgtgttgaggcagaaaaaaagcaggaggaaaggggtgagtggctcctctttaactgttgtggctgaggtccgtttccagtggctgtccatccttttccgagaaacccactggccaaggattctttcctgtggcaggaggccaaacgctggctttgttgtggatggtacttgtgagttcttccaagacgcggcaggggcctctgcttgcacattcctgtgatctggatctaccttctctgcctccttcaactccctgcgtctctaaatccaaagcttggttctgagttccagcttagcagccactccggggcggctgtgagtagctccagccgggtaattttccacagcatctcctggaagtcttcgccatccaggaggtggggctgtaggtgccttctggcgacccctgcggttttcctccagtcgtccagtttaaaccaggggaggagagaagagtattctattctaaatgagtgcctccacactgtacacgcaattctcttggagtcctcctgaagcaccctctcacctcaccaccagtccaaagatagtgtgttgacagtccaccctgggactgggggtgctgtggtgcggggacagttatgggaaggcagatcttacagtgcatcctggagaggggatctggccacaatgtctgactgttttccagtttacaatgtgaggccatagtacctccttgtttccatatgtgggtcctagttcagcaaaagggctgttcaacatcttgttccacttttactcatctgatctttacataactgaatgacctgtggtttgttgccaggttccttgactttgattatgaacaaaaggacagtaacaatgtaaatcctttgggctacccattgagatggacagggaccaggagggtattcaggtggtgccacatgggcattgtctaacagtggggaggatgggctttgtcaccaatgcctcaggtgaagcccttgcactccacttccttctcttcatcatcatcactcatctgctttccaactccattttttcttctctgtgtttttttgcctttcttgccccaaacatgggagttacacactgatttagtctttgtcatttacatttgtgattctcattaaggcccataactttaacaccatcattatgtggatagattctaagtactttcttgtaaagttaacttctgttctgagctccatttctttgtagaattgagctcctgaagacttttgcctgttattccccttatatcttgacctcaatatacaaagtaaactttaaaaattattattgtgaatctccacccatgaaaacatgcccaaaatagcatctttcccaaaatatacactaagttcactgaggtgtccatacttttctgcttcaaaaaatgtttgtttaagttggtctcagaaatgcttgctgtttttctgaggttctgcctctcaagaatcaagctgaattctggattctccaagaaattctagatctccccaatagaaacaaatctatttattctctgtcttctattgttggtagctgtattagagtacttatcagagtattgaccctactaggttcttaactgccagagagcaggtaaccattggtatctccagtaaagcttaaaagaagattttctacacttgttctgaaatttaatttggctaattataaaactatgaataatgaattgtaatttatggaaatataaacagaccatgttgaatattcacactttctttgtccagatctatctccttctatctctacttgaatatttggtagtctacatagaatatttcttgaaagtagacaataaaatattttcagattttttaactgaacattagccgaaataaattattctattcaatgacacacaggtttttgaatgaataactaaataggaacagataagaacaccttaaagtccttttgctgcccagatactttatctgttttggcttggtaattataacttacataagtatgcaacatttcatttcttatttctctagaattactctacctagtagctttcagagcatgttaatgatgtatagaccattagatagctcacacatctataataaatttaaatattttatatagacttaaaatataactaaattgataaggatagataggcatcttaatctattttgtgttactataacagaatacctgaagctttgtgacttataaaaagaagcttatatggctcacaattttggtgtctggaaagaccaagattgggcagctgtgtctggtgagggcctcatgctgcttccactcatggcagaaagaggcaggggggtggacatgtgcaaagagatcacatggtgagagagaaagcaaggtagagaaactgaggaagccagactcttcttaacaacccattctcaaggggcctaatacattcatttcccagaaatgaagcagttactcacccccaaggaagggcattaatctgttcatcaatgatccccatccatgagccaaacacctcctactaggccccacctcccaacattgccacattggggatcaaatttcaacctgagttttggcagggacaaaccatatctacaccataacaaaaggctatattgtgctgtggtgacaaatgatctccaaatctccatggcttatctaagctttatttattactcatccaaaatccatttggcctaggataccctctgaaaccaccatccctcaggtaataactcagtgatccaggttgcttcaatcttgtggcttttgtacatcaacacaaaccaccctccacgaccctccacagcagtggaggagagagtacagagaattgggtgtttctgccataaatctttcagtatggctcactggccacaactggtcacagggtcccacctaactgcaaggagactagaaaatgtagtctttcaggtgactaactgattctgctcaccagctcagtttaggcgagcattagtcatgtctacctcagtttgccattctgaacactaaatattttgtttgttcttcttttcctatgcagcacacacccgctttgtccccaagagggacaacacaaagtcctgtggttgcacagtattaaactcagagtctgggattgctagaagttgtgtaggagtctctacattcagtccacacatgactgtcttgggctggacacttatgatttaaaaagaagttctcagccccctcccctaacacacaacaagtatacaacagttgaagaagaataggatagatacaatcaacattcaggaaaaaaaatggaaaataaaggtccagaactggttcttgcaaaactaacatttccctgcgaagacattgtgctggcttataccctctgctgatgaggtcctgactctgctcttaggaggctctctcaagaccattgtcctctctgggttaggctctgttctctgaaatgctccttctccattatcctttttggttaactctgacgtggacattggacatatgctttccttgggaaccatgaagctttgtaaaaatgttgctttttaataatcacagtaacaataataatgctcaccatgtgtttaacgtattcttttcgtaagacattaaataaaatgccaactctccccatcatccaccaaaattttctaaattaccatttattgcataaaaaagcagatggaactggcatttgaatcatatttatctaaaccccaattgtgtattctttccattacatttttgttttttaatgttatttttgaaaccacatttttaatattgatataattgtcaaatcacatgctgtttgcagataaattctacatgctatgagattaagaagtaatgcagataaattctacatgctatgagatttcccccgatttgaagttgcctgcaaaactgtagaacaatatgtacatagatatggccaagatatgaacatttccataatcacaaggctcctttgtgctctcttttgtggtcactcacccctacttttctcctgcccaaactgcctccttaacttctggaaaccactaatctgttctccatttctataattttatcatttcaaaaccatgatataatgaaatcatacagaatgtaacttgctgggattggcctttttcattcaacatgattctttggagattaatccaagttgttgcacgtatcaatcacttgttgttttttgtcacagagttgtatgcatgctatgaatgcactgcagtttgtttcgcctttcacccattgaagcacatctggttgtttgcagtttttggccagtataaataaaaccatataaacgtgcatctacaggtttttgtgtgactatacatttcatttctctgggatgatgcttaaggatgcaattgctgggttgtatggctgctgaatgtttcactataagaagctgccaaacggtttttcagagtggctatagccattttacatttataccatttactatccaccagaaaagtatgaaagatccagttttgtacatcctcaccagcgtttggtgttgtcatgattttttattttaccatcctgatagacatgtagttatgtatcactggggtattaatttacatttccctaatggctgatgatgttgaacacatgtgcctatatgccacctgtgtatcttttttggtgaattatcttttcaggttttttgcgtattttatatttgaattgtttgatttttcctgctgaaattcaggaatttaaaaaaattattattctacatgctggttcctttgttggatatgtatttgcaaatattttctctctgtaacttgtgttttcatcatcttcaaagatatttcagaaatcaagtttttaacttcgataaagtctagtttatcttttttttttttttaatggatcatgcttttggtgtcaagtataagaaccctttcccagaccttgatctcgaagcttttcttctactattttttctaaagtcacatagttttacattttgcaggtaagtcggtggcccattttgagttaaattttgtgtaaaatgtaaaacttaggttaaagttctttttttttttttttgtcctgtgatgtccaattgctttagcaccgtttgtttctaggcttccttcatgttggtttcatttatttgttattgtcatcgatgctgaactggacatacctgcatatttaactttttggtgcattaactaggctttctcttctttaataattgattcctaaaaatataatattgaaataactatatgaatatttaatattttgaaaaaaatttaaaattatgtttcaaaaaggattcaccaatttatatttccaccattagcacatgaggtttgtatctacccacatccttaattacagagaaaactatcagttaatttttgtcaattttatgattgagacatttttattttcaattttcttttctctacttaataaaattgtgcatatttacctaaacatattgattatttgtagttttttctttgattgtgatgatatattttattgattttctttttttccaccttttattttggattcagagggtacatgcacaggtttgttacatgggtatatgctgaggtttgaggtatggataatcctgccacccaggtactaagcatgctatccaataggtagtttttcagcccatgtccctctttctctctccccacctctagtggtccccagtgtctattttttcccatctttatgttcatgagtacctaatgagctcccacttataagtgaggacagtggtattggttttctgttcctgtgttaattcactaagaataatgaccttgaactgtatccatgttgctgcaaaggacattatttcatccttttttatggctgtgtagtattccatggtgtgtatgtaccacattttctttacctaatcaaccactgatgggcacttaggttaattccatgtctttgttactgtgagtagccaagcagcttttcaactccctttctgcccatagtcagttaggagacaagctcaattagccacatgttcttacagtccagacttgtggtttcttggtgaagtggaccctgggaagcactgctcagacctcatgtagaagtaaaggacttattttcccagcatcctggagtgttgctaacagagagttctccaccagcaagctcttcagaatggtctgacttgaagagagctgttttacccaatgttatgacctttctgggaagcccacatccataactgcccatcacaagagtgtatagtccctgtcctttgctccagttggtgaaaaccatgatgtatcacccagctactcatgcctggctgacacctccactgaggctgcatcagagcccaacttcttttctgctgagttctgcttccttcccttcccttccacaggtgtgttcccagagcactcccttgaaaacccctgcccactaatccctctttcagagtctgtctcccaagggacccaaccagcagtgcttagcagtgcaactccttttgaaacctagtagacttttggtctatttgattctagtcagttctatttgttattaaccacacccaaaggtctttggttcttggatttgctgtatttcattgcttcattgtctctcgcaaccctgcctctcattcccaacttgaagaggtgtcttgagttgatctggagtcaatgggagagctacacctttgagtcattccatacaatttagaatttagtagatcctatgcccttagtttgctctttgcacagaagaatcttgatccactgtgaggcttaacaataggtaggaagtcataatcttatttttatttttttagagatagggtctcactctatcagtcaggctggagtgcagtgccacaatcacagcacactgtggccttgaattcctgggctcaagcaatcctcccatgtcagcctcccgagtatctaggactacaggttgcaccaccatgtttggctagttttaaattttattttgtaagacagggtcttggtatattgctcaggctgctctatgttgctcctggcctcaagcaatcctcacacctcagcctcccaaagtgctgggattacaggcatgagcaaccacacccagcgtggaagtcataactttaatattatcctctccccgaggctaacttgtagtaggattttttttttttgagagatccttaaggtcctttattaatggtttaaaatactttacatgctaatacattcttaccctacagggatgacacttaaattttactgagccatgcaatatagggtgacttcaaggctgaggaaggctgctgttttcaaaaggatgccaaacctgggcacatactcaatttctgtataagctatacagaaatatatgaaatatatattttctatataatcagatatattttatatataagcacatatttatgaatggttgacatatattttaatattttatatatttctctagttaaaaatatatttctggatactaatatatactatcttaagtattcagataagctctgaaatgatgaagtttgtcagtcattcattcctttgtaaattataatattgtcactaaatttttcacaggaaatgagaggatgcctttatgtgtgtgtttgtgagggtctgtggataaggattcatgtgtgtttttgtaaccaaagagccactctgttatttaacaatagaagatatttctcaatttgatttaacatttatattttccctaatctcttgctaattagaaaatgtgtctatgctttccaatgctccagttcagtaccctaaaccacagaattcccaagagaattgttagaattcaatgcaagatggagtttttcccaaaaaagccagtgttttcttcaatctggattcagacagcagatgaggtcaaagaggcaaccaatacttatctctggaatctccatcaacctaatccatccatataaaaaaatgcctatgctgagaataaactgcaggtaaattcaagactctgataactgtgggcaaaaacattagaaattgaaataaggtgagttctaccaacaccttccagttttacaggcagaaaatgtggtttgctatataatctgtattaaaaacatcttccttcttccattctgctgcttagagcctgagggatgctggagccatgaactagaaggagctcacctcccagaaaactttgcagatcagagctcaaattcttgccttggattgtgtacctccacatttttaggtgagcgaaaattgaactttggattgtttgagccacagatatttagatttgcatcacatggagaaaaatctaattccaactgaaacatcataccacttggagtaaaatccaaagcattacacagctccagtgatctggttactagcgacatacacccatgagtttcccactctgtctaccctaaggctacccagactaacactgctggctcagacccttagacatttcctcagcctacattattttttcccaagagaattgtatggctctttctctcccttaattgagttttctcttcaaatatcatttttattagaatggccttccctgatctatatattcatattaactctatcctccatctcttcattttcctggtttttcagctttgttgttctccttaatcctcatcataatctaaaatgctaactattcacacacttatttgttcattttttgcctctctccactagtatgtaagctccatgagttcagagtacctttttacccactgctgtatctccaccaccttgaatagtgcctggcttattgtagttcaatgaatgaatgaatgaatgtgaaggcacatcatctagaccaagagaatacaatagctagttgatattattatgtgcctgagagcccaaaaatattgtaaggtttatggttttcaaaagttaggaagccttacatagcaaaaaaaaaaaattaaaactgttccttctttgccagaaagctatggatattcaatcatatccttttaaacagtacagccaatatgggagaaaattgatgagtattagaaatcctacagaaaaaaaatgttgttgctatgaagtaaatagcttcagctgtaagtaggcaaaaaatattttcatgaaaaaacaaactagaaattcagtataaatttagaaagcaaacagttaagaaatttagtgtaaatttagaatttaattgtgtagcattgctatagacttttagaatctgagattttcaagctcaatattttttctcagttttatcttctattatttgggataaagaagcaatgggctttcaactgttcaataatccaaatttccaaaatctcttcttctacattactgcttacaaattggttatttctttctgagcttctttctttcttgtaatttttctgtcatatgtagtcaaaagcatttaatgtacactattaaaattttattttccaaccttctttcctagagtgacactttaattagctacctaatttgcctctaaaattatctcagttttgctacatgtttgccactccacaacatagtatcttgccttctgactactaagccattgacatacacatttgagatacttgtcagagccagacccagctcttgctaccaatatttttatcagtcaagataaagttggttatactttggtacaagcatgccaaaatcttggtggctaaacacagcaaatatttgtttctcacatacatataatctgctctgggtttctgggtgactctaaatcaatccagtgggttagctttcaggatttttagacattggtgtatctcaccccactatgaagattcttccatgacaaccacagcagggaagcagagagtacacaaaattatgcacctgctccttagtgctgcaagtcagaagggacatacataacttaatatttttaatcgatcattggatagaactatgatttgcccacataagtatgagaggactaggaaatgttattctcctggcctccaggaagggaaagagaactggatatggtgagcacccgacagagcagtgaccagtgacaatagtaatgcctgtcaccaatatcacaggcattggtttctgcttaactccactgtgaactcaaaagttaaataaaatttttcatcttctgtaactgtcaccatttgatccaaaatttaaaagtagttatatatagcaaaggaggtcaatttgaaacatctttgaatcacagactatgccaaatcatccaggttgattatcatatcacaggaaagtgcctttgggtaacagttgcatgctgtattaggatcctaaaattgaaatctgtgggcattctaaaagggctatcatggatacaaatcttagtaattatttcatcattatcatcatttttttttactattttattcagagcaggaatgtttagaagaatgtttacagtttggtaatctttccaaattgtatacatctgattgtagaaattggtggtataataattcagaaattatatttttggtactggaatgcatgatatttttctggaggtactttaaaatacattgttatattttatttaagttgggtatgaaaatatttgacaagattattgccgtcagaagaaatataaaaggcatttgctccaacttcacacacatatagtacacccgaactgaacacaggataatgaggccagtactgtcaagaaactgtccaaggaaattaaattgaatgctgattatgtacacactagaaaatcttcaaagaagattaagaagatgattactctaatgaccactaatggagtattgtgtgatttttgagttacttaaccagtaatgggggtggattatctcttttatctacattctctcattttgttgttttaaaatttatattctaactatccctcaaattatttgaggtgggtaacacaagcctggtggacttccacttccagcaattgagataatatacacatagtcctcctaccataaatatctataaaactggatgcctatttttaggtatcagacaaaggcagtacaagactgatccttgagggaagaggaacacttgaggggtgctccatctctctgccaagggcagtgtacccttagcacagagggcaagttgaggctgagccgagcacagtggtgcagggaactgggaggcagagaccaagttctggcccctgacacaaaggagcaggcctaacagatgccacaaaggaggaagccacacacaggggcctcgagactgtgttgtctctaacaatctttcttcaaacgtcatctgcaaaatttgattttccctattggagtttaaaactgtgaggtcctgaaattggtaagactttatttcaaagttgtaggtttcctctccctccacctgcagagtaacactttaattacataaattagtcatatctctgaaatagtctatcagacactaggtgttcattcaatttccaaagaaaaggtcaccttttcctgggcaatatcctcccctggacagaattttataatcataaattgcacacttttagaagctgtcattacaatatgctaagattcttaacttctggtaaaagtaaggaataaaagttcttttataaaaaatattttatttttaaaatgacagtcatttctctactcttccatcgtatgctatatttatcagagcttatctagttattttttctttttgtgctttactcatacattgttcttagttttcaagttgccactctatgttataaaatacaggttcttgggatcccttcaggtagtgaaagagactctttgtgaaggagcctgggaatacacttcaaacaagccccataggggtatctcattatcaattgagtgtggggagctcatgttactcaaagttggttttgtgtttaaacattcacaaaggtccctttatcctccccaacctgatcaaacttggtgtgtgaacctggaagctatctgtctttctatctatctatctatctatcaatcatctacctatctatcatctatcactttcagatcaaaccatattataaatactcacatttagctttatttgggttattacctaaaattttgttagttggagaactacaatgaaacagtaaaaactagagaatctgtattattctcttgtttatgatataagctagtagcaactgaccttaatttccaactttgaaatctacacttaggagagaaagatctgctttggttcatacatttattcaaaaagtaataatgaaacaactaatagcattgttctaagccttatgattatgacagtgaacaaaagagacagaaatccctgacagcttacccttttcatgaaacttggcatagttttaaaaaggaaaaaaaaaaagagagagagagagagaatcttaccatagagttgccccactttttttgggggtggggtggggacggagtctggctctgtcgcccaggctggagtgcagtggcgcgatttcggctcacggcaagctccgcctccagggttcacaccattctcctggctcagcctcccgagtagctgggactacaggcgcccaccaccacgcccggcgaattttttgtatttttagtagagatggggtttcatcgtgttagccaggatggtctcgatctcctgacctcgtgatctgccctcctcggcctcccaaagtgctgggattacaggagtgagccaccgcgcctggccgagttgccccgcttcttatgtactaacttgtgtaactcaaaaataagaaaagaatgaggccattttgcattagaagtgcattcagtcagtttgcctcagaataattttctattttcttaggtgagaagactaagtataacctaataaataattctggtgaagataaatcaagaggaacttggcttgcccttcatgaaagaagctaagtggatttaaattagtttcctgagagtgagggttgttaaacacaaaatgagtggttaaaaaaataggaaaaacctttactgacaaatgcgttcagacattatgataatgtttcaggcaaaagcttgaaacccttcctcctacaacagagtatatgcaatcaagtattttcatgaaaattttagtaaggcgtatctcattttagcctaacggaatagcttttaaaaaaatatctaccaacttatttcttttcctaacttttgattcactatatactttaaaaacatttaaagttatgttgactaaaaattaaagtaacagatcttagatgttaaatttgtagaaactagtctccaaattagtttcaggcacagataaaagttacattttgccattaaaatgtgggtattaaaataaccagttgtcttgtgaattatgaaggttaaaaacttttgcaagcttctgccgcaaccacagagatgcacagataaacgaagagagaacaaagccttgctttaaaaccgttggatttaaattctggattggaattaatgaccacatcagggaattgggattgtttcttcagagaggaaatctacaataaaggccatcatttctacagtatcctcactaaaatttctatagcaaacatgtgaatttgggtgattagacaaaaactaaatatattgtacttaatatttacaaatatataatggatattaatattgttatagacaccttgtaatgcaggcatttgtataatatggaaatgggagaaagcctaagtttaaaataaggagagctattggtactagggagataagcgtgatactgtgacaagaagaaagaagatagagaagaaggcttatttcactcaaatatttttggaatttggaacacgtgaacatttctacacaggcaagggacatttgctttttattgtgtcttacatttttctatacatattctaattgatgtgccataatgagaacccagatactgaatgagacgactttctaatgatactgaaggattcttatccaactaaattcaacattgagtacactgctcagacaatgcagagtgataggaagaggagccgttctctcagaagcacttctccaggacctcagacttctccataggtggggctgataacaaggctatgtgtatcaatgtgactaacttttgcataatagcagtaggggattctaaaaaggcaaaaaaagccttctgattttatctcataacaaacacttccaaatcttttgtgatgtcatttatttaaagtatggaaagattcctttaggtatatatgatgctttagggaataaattacccttttaaaatccaattcatgacgcaaatgtgttgaactgaatgttttctaaaaatttcaaaagaaaatgtattttaggttctgctgtcaataatcaggtagtatgcatattttgtgtagttgataattcttttctatggtgctatctaatcatgctatgattcatagataatttataattctttaagtatatgacttcatttttggaaaagagaaagagaactaagtaaatgtatcttcttcatttacctttcaggaagggcctgaagaacactgagtctgtgtttaaaaaaatttaaaatataaaaataaaaataaatggtataaatttaaaaaatcatgaaggacacaaacattgtttatctcattgtagtagtccataatttcttaatgatggctattactttatgcctgattaatgaaaatatacaaaatacttatgacttttgcaatttaaagaggaaaaatacaattgtttagataacgagactatggaacaactttatacatatcagtctgttgactattagggcactaataagttattatcattgtgactttggaaagtagaatggaaattagtagaaagatgcagggaaatagtgaaggagtgaaagccatgccatccaaatatatgcaagattgatatactattttgggttggaaacattggagaaattgtagtttcagaaagtgtgagctgaccctgtctcttcctgcatccagtaagtcataaagattcgtctaggagggatgccctccccatacaagggcaaaaaaacagcacttatcaccagagactgggaattggaggctgcaatggatctgaataaattcacttaatgaagtacactttatcttctactagttttataccctcccaaatatttcctagtgactcccctagaaatttactgcttctagccagtccccttttgtcctttcatttcttctcaaatttattatttgtttcaacgatacaaaagcattttcctttgtccacttctttggacttcactctcttgtgaagattcccttatatgtggaaaactaattaaatttgtacgcttttctcttgtttatctctgtggagtcaattctagatccaaatgaggagcccagggttggaggtgatccctggctcccctgcaatagagaatataacatatctgaaaactcttcttcagctcatcttcaaaactagtctgcaacattaatgttaaggtaagggttctaattattgtcttcttcttttccagtacaaatagtaagactggctcagaatctaactctttgtgtagaattcttattgactgtcatgaacatggtctagttttggctaagcacaaatattcacagtatttaatatgttacttagcattagctatattgcttagacacctttgaattcatttgagaattgcataaattacctctatattaggctgccggtggtaacttagttaagggtcaaataattataatttctttttggaatcagtttttatcatttatgactctcacctctctcacaaaacaaggatcttcctttaagaaccccaaattgaaaaccaaatatctgagaataatttgtgtaacaagctaagtaactctaaacagggacacccctgcctaggtaccttaggtaatgatcataaacatgagattctttccctgatccctgcaaaacatacctccagccccagatcaactgggaaatattacaatgacttggctactaaacagtattagttggttggatatccctagattcaagcgtacatgggtccctcaaagatttctttaacctggaacttaacacaaaaagaatgatgtgatggcagaataaaaaaaatcttaggggtcaaatctactgatggtttactttacagtttctgccatagaaagatgtggccagtcccattactgccaaaatcttcacatattttattctaatttctttatgattttggtgtttatatttacttattaatatatctttttaccttttataacatatttattgaggttataatgagaaataacaccatttagacatttcaggttttaatcttcttggttacacacataaatacaacttaaagggtatagattactggatcacaaatgtttttcttagtgttttttagactgtgatgcattttcttcttgaatttagcattgatgaaaatgatgccatcaacctgattattgcatctctttcatcgcctgaatgcatgattttttcttatatatttgaaatgacaataaaagagaatcagggtaggtctagatgttggtctcattctttgattttgctttgtgcatagtgagaactgttggtctggaaattcagatattttgactttgacaattgcttctgtaatctatcgggaattgtatagtaggtagtatgaggtaaggatgtagccattttgagggaattatttgaggaggatcaaaacaacatatggcaaacactattcatgttttctaatgataaagttgggcataagcacataaggggtatatatttaccaatgataagtgtaagcaaataagcatcatctatgatgattccgaacgtggtcttatattgccgtcaatatatctttattaaagtcatctttggccacaggtctttaatagtcaaggtctttgttttatttctgctttgaaacttacatattttacttttattcaggggctctctgacttcttttgtaccagctcagtattgagatgaagtatttcctatggtaaactactggcgattattgctgtacttcctatttcattaacttaaaaatattaattgagttcctaacatatgttcctaagagggtgtggtacctgctctgaaggaatttacaatttgatcaaaaagccagacaagtaaacaaattacattacatatagtagtgccatcaaaggcatcttagaagaaatacaataggagagggatctggaccacttcctgctagatcagaaacatctttggccctacaaatttatgtgttatactgcccaattggttcgttcattcattcattcattcattcgtgttgcatatggttttcgggcaatgtcattgaaagcaagcacaataagaaacactgggcattttcctcatgttgcacatcttccttacctttcttctaatttgtatttcaaatgttattttgctattttaaactattttggtatttttctgtctcagtttgggaaaagtagagaattagcataatgatttaggtacatcaaacaaaatatttttatatatgtttttcaaatatttcaacctggaatttgcagaagaattatcttaattgtgtgtacaatttcaaggcaaaaggagttataagcaaacattaaaaaggcaggaaaatctaagagattattttgctattaattttctcaattaaattttgaatggctacacttcatggggctcttgaaattcctatagcataaaagtaacagagaaacaccgtgcagagtcttctgtttatccctccagtccctcactccttctccctcctgcaccagcctgcctgggtccagctgactcacctctatgggctgcacccacaccctcccttgctctctggcttcccactaggttaggccaatggacaccccacaggaggtcagagggcaggaagggattgagtggtgtttcctgtggctccttcctgtgaacctgtggagtgaggagatccagtcacatcctcctaccaagcttttggtcctgccatgttatctagaccacacagttccagaaattgctcccttgtttcattctttcaggcacatggaggttaatgcctcttcctcctccactgtggctcctccataaggaccccaaactgaaaacaagatatctgagaatattttgtgtaacaagcaaaataacctctagtagggacatccctgtgtaggaatctcagagaatcatcataaacatgaggttccagagtacactttttcttatttctactcatttccctaagcattactcatacttttcatagtcttctactaagactttgcaaattccccaaatccagtgtgctattggattaccaatgggactgaaacatactctaaattgtatttcaatgaaaaacccatgaatggagactgtctaaagtataacttgggcaaactggaagtttaaacagatatatttcttcattttaaaagatgtcaagttaaaagaacagaataattataagggagaaattatatttccttataatttgatctcattataaagtagtgtacaagagtttatattttgacttcacgttaatttgaaataagcattaattatttagaagcttcactaggaagattataaaatatgaatgtaaaacattatatcatgctgtactagctttggtaactacaactcatccatatcagaatgtctagcactcagtaaatacttattaaatgaatgaattgcccataatgcaaaagtgtatgttataacttaagtgaatgtatttacaaaagaaaaaatcttcagagaattaaatttcatcagataaggaaaaataaacaggatttaaaaaaatagaccatcttacacttggaaattttcagagttatatatctggactgagaagtgaaaagaaattggacagcttagttgggaaagaggttgttagagaatcgcctcctagttttcgatgatagtcattctgatggtttattgcaaatggacttgaagcaatctggatacaagagggtagtacattactgacattttaagtgctatcaagaattgacatttcaagcaatgttttagttggtaagcagaaatgttagtagtctggaaagacgttaggcaattggccagttttattgactctaattccatggctttattatatggtcagtatttttttaattccaagaatttccccttgtgtacatatttataaggctccctggataacatgttttgttccctagtcttctatggcaataacctaggagagctgccatttgtaggagtaagaaggagccagggctcaggcaccaaatggctgagtcttgaactctgtcttctctgcttacaactttgtgaccttaaacaggtgactgacttttgcatgccttagtttcctcatctggaggatggggatgatgataacaacaccaatctgagaattagatgagttgagactccacaagcattcaacaaatgtagattatctttcccagaagtgctatttctgctggtcatctctaagcatgcccagtttctatcagagtataattaaagacatgaaatgaaaacattccatgaattcaacaggcaaaacatgtaatatttcttgacaatttctttaacatgagctagtcttgaaacaagtcaaactttagaaaaaaaaaaatctcacatgctaccttgactcagttgctctggaatgactataatttgagagtgagatgctaggagccatcaaatcaaatgatgttttcctgtccataccataaacaatgctttggcttttcagtgcactcttgcatacttctagcacagtgttgttttatggcaacaggctgtggtgcccaaatcttcacatctggtagccagatcttgtgtgcatgaccccatctttgatccccagaacctgtgtagccttttggaaggggaaggtcatctgaggagaacctactcagggagcacagcagcagaactccctcaaatcacagcaaaggggggagtgttgcttagagatggcacaatctgagcagtaaattaccacacagatgccatggttattatgtcaacttattataccttttccacttctcagcattgtattctaagtacctaaataagaacctccatgaattatcaatattatctctgtgtcactcacatagggccataaaagaaagcagataaatgataatagcctttagtcttctattaaagttctgtgacctttaagttacagaaacttgggttgtacataaattatctgcaagccaagctgacatggtgatagagttaagctgtaaaaatggccaacctcacaagtgactcagttggccaagaatgatgatggacaaaccgtgaataatgatgcatatccaggaccacttctaagcatatagatcacaggcagcacaaaaatgctttgactgaggatccatcagaggcatctttgcttccaaatactgtatttttccactagccagcccagtaactgaaaacctagaggctttccttgggttgaaacatctttgaaatactttaaacaacaaacattacctgagagggttcttcattaactcagtagcatcctttgattcatttattgattcattcattaaacatttattaagcttgtactgtgcacttggcagtgaaaatagaaatgaaggctacactcacctctttcagtcagcacccagtctagctggaaacatggaggggttaaaaacatgtcttggggaaaaaggctgtggagaagagattcaagtgtcatgaggacccggaggtggagtgcctacacctgtaaggagttaaggtatggctgatggtatatgaattctatcttataagtaacataattcagtgtgaagattttaattgggaaatgatatcatcagatttgggtgtgagagctaatactgaggcagcaatataaagtagtgaatggggacaacaggctggggaagtggaaatatggaaattaagaaagctattgcaatgctctaggcaagacatgataaaaacatgaactcggctggtttagtgggaagttaaaggaggttttggattcaagagtttatttaggagtcaggatcagcagtagttctgattggaactttgggtatgagaggtttctggccaggatgactgcatatctctgttggtgctgttcataaagagaatatgataatcaggtttgagggatggggaaagtgatgagtttgctgtggaaagctgggtgagagccgccagtggatatggaaaagaaggtggccagtaggcacgagggcacagacgcagggacttagcaggaatgagctgggctgagtggcagacttgagtgctgtgtcaccagcacagagaggtggttggggctgggagtatgaagtccatttccttttaactgttacattaccaaacatctgacagaatctggatagcaaataaacacacactacaaatgcaatcacaaacaaccatgtacgtacacaaaaagcatcatattatgaaaacatgaacacactgtgttttagtgttaacttatgggaaattattatcttctatttaaaatgtaatagcttccaaagaagtaaaaatgaagatttggggaaagagtatgaaagtattctccggtgtttagcaaaggtgttttctcatgacttcgttattgacaactagggcttttggagtttaatggcatattatgaagctccatattttgttcactgctaactgttataggtgattctaacttaattacctctttaaaaattgctataggttcaggttctttcacatcctcagcagctgagaggatcaggacttcttacagaaacagccacttgcacttcaaggctatgtgtgtgattccatggttcattgataatgtgccatttttcttcctgaaaaaagttttgtctcctagggctccactgggatatgttaaaaaggcacaagtgctatattacagagtattggaaatgcagaaattacagggtttggcttttagttatctgagtgtgtttctgtttcttttcttttatttatttatttatttatttatttatttatttatttatttatttattttttagatggagtttcactctgtcacccaggctggagtgcagtgatctcggctcactgcaacctccacctcctgggtttaagcgattctcccgcctcagcctcctgactagctgggactacaggtgcctgccaccacacctggctaatttttgtatttttagtagagtcagggtttcaccatcttggccaggatggtctcgaactcctgacttcaggttatctacccaccttgacctcccaagctactgggattacaggcgtgagccaccacacctgtgtatgtttctggagcataactctgaagcaaaatatacaactgtgatgccctgagaagagaatgttgtgttaattgtaaagttcagtcatcacaacttagttggctatgtcaagaccttgatgaaatacaaaagaaaaatgtaattttaaaggcacaatccaatcagaaaataaaatttataaaaatattttttgggcctggcatggtggctcacgcctgtaatcccagcagtttgggagactgagatgggcggatcacgaggtcaggagatagagaccatcctggctaacacggtgaaaccccgtctgtactaaaaaaatagaaaaaattagccaggcgtggtggcgggcgcctgtagtcccagctactcgggaggctgaaacaggagaatggcgtgaacccgggaggtggagtttgcagtgaggcgagattgcgccactgcactccaacttgggcgacagagtgagactccgtctcaaaaaaaaaaaaaaaaaaaaaaaaaaatttggactacattccttacttccatgattttatgaaggctcaccaagtgagaatttgagatgaattatttacattgataatattactgatagagatagaaatgtgttctttcttgttttcactgtgaagacacagaatttcatacaattccaagaataactgtatgaaagtgccttttgggatgcatccttggtttttggatttaaattgacctctgttggttgctgttgttagtgctttcacccttgtgaaaatatcttcatatataagaaccacatagtcaaagacagttggaggaactaaaatgaaattattccagttgaaatattattgagaaataaaatcataggataagagaaacattaaaaacaatgtctaaaatcattgtgtcaaaatctgaaattcactctcccacatccttattcataaatttatggctaaaattttaaaaacccagaagttaaaaattagaggccatatcaatgaagagttgatcattacatgtacatgtttatttggttctatattataaatgtgctgagcaaaatagtgtcaagaaatactatgaaatcacacatttatttattcaacagatatttattaagggcctattccaggtactcttctggattcgatgtacaagtctcttccctctggcagatctaatgggtcaggtagataataagcatgcaaacaacaaaatattgtgtaatatcagctggggctgtgaagggaaccagagcaggataaggggagagagagatgtagaaaggtgtcactgtagatcgagtgttcagagaaggcttctttcagaaggcagcattgaagacaaccctgaataaaatgaggcagccattccctagaagaatttgggaagagcatgacagggatagaaaatacccactgcaaatactaagaaggattgagctttggtgtgaagtcagtgaagagggtgataggagatgaaattgcagagagggagtggccagaccacagcaggtcttgctagcctgcaagaggaatttacattttattctcgttgtaaaggaagactgcagaagcttctgagcagggaggactccaaatgatttattttgtaaaggattacaccagctgctgtgagatgcaggctttggagcagtggttctcaagagtgttcttcggagcagtgggtgattttgtctcccaggagacattcagtactaacatgtattaactagaaaaactattaaacaactaaaagagggtttaaaaaaaaagactctaaggaatgcagaaatagcaactgaaggaaacaggcctaagacagagtaaaccaggaataaataaacagcttggaagagggccctccccaaggctgaatgtgacctcatcagagaggcagtggctgccaggagcacctgccacgcctggagggaggaaacttcttcccgcagacataggttgcagctccacagttagtaaagtgctggtggcagagaaactcagtgaatgtggcagccacaccataggaaaaaagcctactggaatcaagaagagaagcaacttcattttgctttgacaaagtctaacactgtgccagctggcaaaagagaaatatttataggatctaactacagtattgcaacactgggcagagaaggagggatttggtgctgacaggcaatgaaatgacaacttgtatcatgcaccccttttcaggttccatatgcacacttcctcaggcatttagactcccataggacaattaaacacctttaccttttcacctaacaagatgcggctattgttcctacaagtgaagacattcttaccctttcctccaaatgaggagacatacagtcccaatagtcactgcaactgtcacagaacatattagttactcctcaaatttagtcatcttccactgagaaccctctacccaaagactaacttaaaaagttaacttccagtgaggatgaatctttacttcctccatgttgagcctcctgtgtaatcaacctgcaactaggtagctggctgtacctctaaaagaatgattccatatttggggctaaaacatttctctctgctgttggctgattagagactcagcagtagcagcatccaggtcagccttgataaagagaaatccatgttgttgaacccatgatagcctccattcctgtcaccatggacattttgctcttgggttcataagtaccgtggtgctggtgaaagaggctggccagcatccatagaagtcatcatttttccacctgattattgagatcctccattgcagagaatgctctttgatgagtattcatatgagacattgtggtaggcagtctgcctgatgatgcctggttcccgacattcatgctcttgtgtaattccctcccccaagtgtgtgctgaacctagtgtcttgcttccgggaaataaaatatagcagaagtgatggtgtgtcccttcagagattagtttctaaaagaccatgacttttctcttactggtattctctctctggttctgtttgcatacttgtcctgatagagagggagggctatctgccaaggaatcaaaggtgacctctggtttacagcaagtgaggaattaaggtcttcagattcagaaatggaatctttgccaaaaccatgtgagtgggcctggaagtggctcttttccctcaagacttcactagagattgcagacctcgttgatgcgttaactgcaatcttatgagaccatgaagcaaaggggccagctaagccattattggattgttgttttaagccactaagtttttttgggggtaaatatacagcatagataactaatacagacacaaatatcttcacaatctatgtccattttgagagacctatctatgtaactctttcccaaacttcactgtcaccagtcttccaatcctgtcctttgcacatcgcttaccattcagccaatcctttagcttttgcccatgaattgatgtacagtaatatttctggccacatgtcagtctggtcaaggcagacctatcttgtttcaaataacatgagagatgtctgagaaatcaaataattaggattcaattttattataatttttgagggctttttgaatgtgttgtatgttttaagatgtaaactcagtcacttcctctttaaaatgcttacatattctagggtcagaaatcttattctctgccactagaaagatggtcatgatttttataccatcagcaaataatctgatttctgggatatatcattaatgtcaccaagggttgatctttaataggctactttatctattcccataccttttgatgctctttataggaaaagatattcaaaatctttattgtctcttctgggatctcttctaatctctggaattaaatttccaattttctcttgaaattttcaccaggaacgtcttcatcacaaatataatgagtctaaaataattcttcacctctatcttctacagactactcctttcatcttccagctttttctggccaaatttttcattttcctttttttctatcatctgtaaatggtatcatccttcttctagtcttgtagacaagaaatgtcaaaatttctcttttcccagacaaccatatgcttttgtgtcttcatctttttgcacatatattgtctgaatagaactgtccttatcctcattttctatatccttcaggaactagctacagtgccacatcctcaatgacatcttccctgatttctcccaattgacaagaacagttccttttaatggactgccacaagactttgcctgaatgctgctttgcctttatcacagcattttatctgggatggaatttttctaaagtgtgttctgaagaagactagtcccttggaagcattcacatagagaagtgttcttaggacatattaagtctaaagaattttgtctactgctctttgtcttggagtttcctgatttacatgagcatactgaagattctaaaaggatatgcaataaagaaagttatttatctttaatcattttcacttattgtctaccattatctttcagagctcctttgccatatacagtatctgctttcttattgttgtatttcttggtactctacacattatcttatgcattatagttacttgatgattgttgactgtgatgcatctccctccacactctgagctggatgaatctcagacaacattttggtaatattttcttgtaggcaattctgctagaactttaaccaggccatcgggaactaaaggaaatgaattattaaactactactgactgagaaattagaactgcttgaggcaactattagtggaagaagtgaggaagatgaatacatgacaccacgggaatttaaatggaacatttataaacttttggaagtattaccactggcttgatgaaagaagacataaaaatgataagaaacccaatattcaaatgaaatatcagagcattagttctagtgaataaagtactgatgagtcagcccagtcagagaagcatccagcctcttctaggcggtctattcattaaccaacttttaataaggtgcagtttgccatgacgtggttgactgttgcgtagtccatgtaggtactatatttgaagaatttaaatctattgttacatgactccctgtgctcctggcctgccttctaagatggtaaagaggaatccgttttctcctaggcttttattaataaactcagtggccacgttgctgtgatcatttttccctttagcgctgccttcagaagtacaatgtgcagaaattggaaagtgctgtcatccttttagtgtcatcaaaaacatttcatttttaaacagtaataaccaagctgctctaagtggctttgtcccgaaaaaaatgaactcagataaatgttgcagcttattttattatgtgaaatgccttctgaagaacatctgtgtaaacagaaccacatcatgcacacacttctgccctgtcacttgggcccggcagtacctttattgtccattactcagtcgtaatgatgctcctggcacaaagggttccaatatgaagatatattttgtggtattttgaccaatttgtattcatcatcttatctttctaagctataaagacgaactgatatcagagtggcttatttaatcctgttttagcctccaacttaaattctctaagtgaaaatgatttattaacatagaaaaaataacagctgactatgtgggactaatccttcagaaacagcaaaagcagaaaatgattcataggggctggaaaaggtcatttccttacaattgagaagttctttcatcttgaggctattggttggaggtgctactaagtttaaaccttgtaatgaacataggagatcaacaatcaatagaatgatacatttcttaaggaaaatgtttaacttaagattgactggctacttatcaaacctctctttcctttggctcttatgaaagaaatggattagaccctaattacaattgcaaaaatcacataaatatcttttatatttgaatctgaatgttggcttggcactgaaattgcatataataaagcaattagtgggatttagctttgacgattcttgactgatgaatacatttaaaacattttacttggaattcattctgtggcttacaattccagtattgtaaaatcagtgaaatcatgacaacataaatggtatggactgtcttctaatatatctaaatataagttcactatgcttcatagcaactcattaactaaacacatttacagatttctgggaagggcttccaatttctttttctttttaatagactttcactttttagaccatttttaggtttacagaaaaactgagcacaaaatacagagaattcccatcttgtccctgcaatcacttaccttcacacacacagtttgtcctaccattagcatctttaattaatgtcttacatttgttacaattgatgaaccaatattgatatattattaataactaaagcccctagtttatacaagggttcaattttttgtgtcatacaattgtacaggttttgacaaatacataccatcaagtatccacagttacagaactatgcagaatagttttgctgccctaaaaatctcctgtgcattacttattcatccctccttgttccccatctcctgctccctcaaactttgggaatcactgatcttctttattttgcctttccagaatgtcatatcgttggaaccatacaggatggagctttttctgactaaattccttcactgagcaatatacacttcagtttcctccatgtctcttcatggtatgatatcttctttctatcactgaataatattccattgtatgaatatatcacagtttgtttatccagacacctactgaagaacatcttggttgctgccaccttttggcaattctgcataaagctgctataaacattcacatgcaggttcttgtgtgggcataaatttttaagtgatttgtctaaatatctaggagcacatttactagatggcattataagactatatttagatttgtaagaaatggccacattgtcttccaaagtggctgtatcacattgtattctcactagcaatgaatgagagttcttgtccaccaacatttggtgttgtcagggttttgtattaggtatgtggctgtatctcattattacctatcttacaactttctaaagatagagagctttgaccattttccataagcttatttgccatctgtatatcttctttggtatttcttcttctgtatatctactgtgtccattagagcctattgaatatatgtgctcctgtcccaaatttatatgtggaatctctaatccccagtgtgatgatatttggaggtggggacctttgggaggtaatttggtcatgagggttagggatcagtgccattgtaagaagagaatgaaatagatcttaccactttctctctctgttgtgtaagaatagcaagaagttggacatctgtaaatcaggaatagggtccacacctagaactcaatcatgctggcaccctgatctcagactttcagcctccaaaatggtgagaagaaactttctgttgtttaggccacccaaaccatagtagttttgagagagccaggttggaggaggtcctcagaaaaactccaaccgtcctgtgcactggggtggagcctcaggaggttcatgccctttgcagtggggaggagcctggctcctcctcttcctctttggaacctgggatttgagctgcgggtgggaagcactctaacagggactctggccttggagaggatccctgtttcccccacttttttccctttccacccaataaaaccctgctttactcatatttcaaaccatctgcaagcctaaattttcatggccgtgggacagacaaggatcccatctttagctgaactaaggaaaagttctgcaaccatttgttgtagcagcctgaactaagtcagagcccttagcatattaattgtagttaaattccaagtctgatggttccaaaatctctgccatatctgaagctaattctgatgcttgctttgcctcttcagactgtattttgtcttttggtgtctgttgtaattttttgttaaaatccaaacatgatgtgttgtgcgaagggaactttcgttaatgaagttttaaacttaatctggctaggagttaggctccatttactgcttgttgtagctataggtgtcagaagctaaaatttattctatcacccttgtttttgtctcctctgttgtttatgggtttccctagtgacctctccttaaatagcatctgtgacatgcaattctttcagttatatttccctgctattatacagaagcagctccaatgacatggtagtaaaatgtagagggagaagaggcattctatagtcctttgattagatctctgttttttagtgaacctatgcatttggagaggtgaccctaacaaatacttcttagcttctcctctaaccgtcttaggtgagtcagtaaggctggagaggctggagttaggtatttccctctcctagcgatgaaggttagaagaggctgaagttgggtatttcccttactccacatgagttaggctggtaaagtagcttccattgagggcaagcctttgctaagaagaacagaagctctggatgtatttcaaaattgttgcctttcccctccccatgcaggaagctggaaggaatttttattttatcttcatagtgagaacctggtgggattcctggtggtaaaagtgataaaagtgtggggacctcctaaggctgtgcccacagaagtttttctctctcaatctagtccatgctcattcttcagcaattggtcaatcattccttcagtgtttcaaccagttgctggccttagttgtgcctccaccccctgtcagctgtgatcctctgtatccacctatctctctctctgtagagttttggactggtggcttgccctccatcctcaatttttgggtggatctaagaacagttggtgattttcagagcccaactttgccattgctatgaggacatgagtgatgactcccaaactttttacatgtcaaagtgaactagatgtctccttcttgtattttttcactttgcacattttatgaaacagaactttaatactttgaccaaaagatgtttctgactttgaattgagtatttttcctgagttttcctattagcattattacacaaacatcatttaatgtgatgacttacatatgcatcctaaaatcataaccagatatcacatatacaggaaaatgtcaaaatccacaattggggttttagtactttacttctgagagtatgaaggagcatcaagacagagacagtctttgccaaattttccccaaaaaatagcatagtggctttgatggaaagcgaagacaggcttttcaattctgtgtataacatcaacccaatgacgtgctatggacaagtgatttacttttattctgtctcaattttctcctataataatagtagtaacagcaagagcaaagaaaagatgtaatgaatacttattatatcaaggcagtattcttaactctttacctgtactatcattaaatcctcaaagtaatctaagagttggaaaacatgaggcataaaaaggttaagtgatttatgcaaggttgcacagctagtaagtggtgcagactcgctctaaagctctcctcattaaacatgagaaaacaacccaaactccgtgtgatgatggaagtgaagagtatcctaggcagaggagtaagaatgagtaagcttatttctaccctcaggcctttgcaaagatagaaataagtcctaaatgtttgaaggacacaaaagtccaaattgactagagcaaaataaataaagtaaaaaaaaatggaagaagatgagattagagagggcttgtgtcataatagctaatgtttatcaagttcttttaagtattcggtgctgttgtattttatattcgttttcttttaattctcaaacaacactgaaaagtagttctaatagtaatcattactgttgctattaacactattgacagtcaaaacacatgtgacataatttttttaaaaaacttcaaaataacttatggataaaaaagaaataaggaaaatgacaattttttaaaagatctgactgccacagtgcatataagactttcaagatataggtcaattggtactttgaggcagatagaaaaataagtaaaaagtgaccattgaaacaatcattgtaagaatttggaaaggcagcaaagtaaaagcccaagaaagaaagaaaaaattattttaaaattttaataaaaaataaagaataggatcaacaaaacaaatagctcaatcttagagaagtcttttaaaatagtcctttcaaacctctggcaaaatatattaagaaaaagtaaagtacaaataagaatattaaatataaaagtggccaagagtagagttaaaaatatttttaaaacaacaagctatggtatttgcaaaataaaaaataccataaagggttaaaaagaaaagctaaataacgacataccaaatagataaatctgaataaaagcaaggtgaagaagcacaggtagatgatgataatatttatgtaaatgtttaaaatactcaaaggaatattaaatatactttggattaaaaaatgtactgtaagtataaaagcatggatggaaaagacacaaaaccaacttcagaactgtggctgtgatttcaggtggagagcagtatttacactgatttcaaggtatggagattcttgcaacaaatgtgtaatgcagatctggactccagactcattagaaataaaaggctcaggtattcattttggggtaagattttgtttccttcaactaagctaggtataattttccttttctgctctgaactgctgggggactttttctgcactggggtttgtgcatatacaggggtctcagtttcaccttcttgcctcaagtagttaagtcccatctgctggctttccatgtgttatttaaaaaatagctttgttgagatattgtagtaaacatgcaacacgtttccctgtgtccctctagtcctctccccgtctctccttttcctactccccttcccatcccttttcccaagaaaaaaactgatatgatttccgtcacaatagattagattagattttctgccattttatgtaagtacaatcatatagaatatactctatttttttggactggcttctgttgctttgcataattactttgagattcatccatgttttagtgtgtataaattctttattcttttttgttgttgagcagtattgcatcgcatgaatatactgcagtttgtttatctattaactggttgatgagcatttgggctgttttcagtttttggctattagatataaatctactatgagcattcatgtataaggctttgtatgaacatatatctccttttctttacaataaatacttaggaatagaatggctggattacatggtagatgtatatttaatttttaaagatactatcagtcttccaaagtggttgtgccatttcatactcctaaagtgtatgagagtttcagttcctctgtattcttgaccacacttggtatcatcagtctttttaattttagccattctaataagtgttgtagcagtatttcttaaaggttttaatttgcatttgcctaataatttataatgtcaggcagcttttcatgtgcttatttgccatccagttaccttttgtggtaaattgtctgttcacacattttgcctatttttaaaattcgactgtttgtttgcacattactaaattgtgagaaattttaaaaatattctgcataaagatcctttatcaaatatgaaccttacaaatatattcacccaatctgtagattgtctttttattctctttaagcagaagtatttaatttttgattaagtccaatttatcaattctttttttttttttctgagatggagtctcgctctgtcgcccaggctggagtgcagtagcacgatctcagctcactgcaagtctacctcccaggttcatgccattctcctgcctcagcctcccgagtagctgggactacaggcgcccaccaccatgcccggctaattttttgtatttttagtagagacggggtttcaccgtgttagccaggatggtcttgatctcctgaccttgtgatccacccgcctcagcctcccagcgtgctgggattacaggtgtgagccaccgcacccggcctatcaattcgttctttaacagattatgctttggatgttgtatctaagaaaccttagcttaactcaagctcacaaagtttttgtcctatgttttcttccagaagctgtgtaattttagattttacattagacatattgtcctttgagttaatttttatatatagtgcagtatagcttaaagctcgttttcttgtttagcggatatctgtctgttccagtgccatttgttgaaaagactattctttctccactaaattgtctttgaatgtgttgaaaatcagttgtccatggatatgtgggtctttttctgaagtcttcattctgttttattaactaaaatagtctatctttacaccagaaaccacactgtcttgattactataactttataataagtcttgaaatcaggtaatgctagttttccaaacctgtttttctttttttgaagttggacagttattctagatccttacatttacatatgagtttgtttgcttgtttgtttgtttgagacggagtctctctctgtcacctaggctggtgtgcattgggtgatctcggctcactgcaacctccacctcccagattcaagcaattctcctgcctctgcctcctgagtacctgggattacaggcatgcgccaccacgccaggctaatttttgaatttttagtagagatggggtttcaccatgttggtcaggctggtctcgacctcctgacctcatgatctgcccacctcagcgtcccaaagtgttgggattacaggcgtgagccaccgtacccggccacatgcgagttttaaaatcagtttctcaatttatactcccttccccacccccagaaaaacatgttaagatttttagtgggattgcatttatctaaagatcaacttgggggagaattaacatcttaacaatattgagtcttttgactcataaacatggcatgtctttccatttatttaggtctttttaaatttcttgaagtaatgtgttataattttcagcgtacagatcttttacatactttttttttttttttttttttgagacggagtctcgctttgtcgcccaggctggagtgcagtgacacgatcttggctcactgcaagctccgcctcctgggttcatgctattctcctgcgtcagcctcccaagtagctggggctacaggcacccgccaccgcacctggctaattttttgtatttttagtagagacggggtttcagcacgttggccaggatggtctcgatctcctgacctcgtgatccacccgtctcggcctcccaaagtgctgggattacaggcgtgagccaccgcgcccggcccttttacatcttttgtaagatttatccctacatagtcatattgcttgatagtattgtaaatggtatttttaaaaatttaaatttaaaaacatttaaatttctgatcatactaacaacgtataggatgtagaaatgtaaaaaacttttaaatggatcttatatcctacaatcttgataaacccacttgtttaccaacaagtttgtttttacagattccataaaattttctagaatttttttatagattccaaaaaattttcttcatacacaattatagattctagcttctagaagtatttatagacaattatagattttagaagtgttttcatagattccataaaagtttcttcatagacgattattgcctcttcaaataataactgttttacttctttgttccccgaattggacgttttaaaatttctttttcctttcattttttttttttttttttttttttgagaccgaatctcgctctgctgccgaggctggagtgcagtggcatgatctcggctcactgcaaactcccacctcccgggttcacgccattctcctgcctcagcctcccgactagctgggactacaggcacccaccaccatgtctggctaattttgtgtatttttagtagagacggagtttcactgtgttagccaggattgtctcgatctcctgacctcgtgacccgcccacctcggcctcccaaactgctgagattacaggcatgagccactgcgcccggcctaaaatttatttttctttccatattgcaatggctagaatttcctgcataagactggttagaaaggttgagaaaagacattcttgttgttaattttaaggaaaaaacatccagtctttttgtatgacaagtactatgatttcgatgtttctatcttttgatttctgccttgaaaaaatttttttctaggctaagaaaaaacagttttggaagtcagagcatcaccaaaccaaggacagtgattgcactaagtaacattattcttgatactcaatattcaaatatcacattgaatacttttcaaaataaggggtggttggagttaagtattttgttattgataaaaattttggttcaagcactacaaattgctaatggaaattttcctttttgacaatagtgtgggtaggtttcagggtatataaggtaaattctatatgtaaatgtttatttcacatatattttttcacttcttttgtggttatcgtcatttcataagtgctaggagaaatctcttctccatatattcttaatttcttcttagtagcatttcatgactacaaagtactattatggtaatatttataaatacatatatttttacaattataaaagtaatatataagttttatgtaaaagttttggaaattcagaaaaatgtaaagaaaatcaaagttactgacaagtccatatcttacagaagtatttttaacattttggtatatatatttccataaagtcacatatttccaagtaattatgtgtatgaaacatacatataggcatgtagtttcatttggtaattactgtttagagaactttatatataaaactttttaccttctgcttctggttataaatgaggtagcttatatcacacaagtcctcctattatgaactaccataaaaactgaagaagaagaagaaagcaactaaaacatctgtttgaaggcattggggagcaaccaagaaagtcaggatttagaagaccagattgaagtacagaggaaagcataaaggcttaacaggcatgtacttggggtcccagcaggagggacgagagagagtgggacagaaccagtacttgaagagagagggctgagagctttccaaaattgaaacacacactcacatgcacacacacaaacacacacacacacccctaaatcacagatttaagaaactctataaaccaaaacctggataaatggaaagaaaatcactcctagcccatcataatgtagcttctgaaagaccaaatcaaagatatactttaataacagtaatagaaaatagacaaattacctttcaaagagctacagtgacataaaaaaccacttttaaaaataaaaatagtggaagaaaaagaccatagaatttcaaacgcttgaaagaaaacaactgcaaacctgaaatttaatatccagtgaaacatttctttaaaaaaaagttggggaaaataaagatatttcaaaacaataacaatagcagtaaaagtttatcaccagcagaatgcacttaaaatattaagtgaattcattaggtagaagaaaagtgataccagatggatgcatagtaatgcaggaaggagcagggaacactgggagcacaaacgtgtgggtaaatataaaggcatatttcctgtttaaaagtaataataatgttttatagagttttaaacatatgcagatttagaatatatgttaacagttgcacataaggaagagggcagtaaatggagttcagtgttaaaaaggttttgcattctctgggaggttgtaaaaataataatttaaagtatctattagtaagttaaggatacatattataatctctagtgtatgtctaaaagaatgattaaagcatgtagaaataataagttaatggagtgggataaagtaaataataaaaaaattaattaatccaaaataatgtaagaaaggaaaacacaatggaaatgagataggaaaaatagaggacaaagaatatagcaggtatatatccttgttttagtctgttcaagctgttaaatgaaatactatacactgggtggcttccaaacaacagaaatttatttctcacagttgtggaggttgggaagtccaagaacaaggttctggcaaatttgaagtctgatgaccatcttttttgctgtaactcacaaagcagtagagatgagggatctgtttggggcctcttttatatcggcaagaatcccattcattagggctctgccctcatgacctaataatcacctcccaaggcttcacctccaaataccatcacattgaagattaggtttcagtatgtgaattttggggagacacaaacattcaaacttttggctccccccagattcatgtccttctcatatctgacatacattcattccatctcaatagtccccaaaatcttaatttgttccagcatcaactcaaaagtttaaagttcaaagtctcatttaaaaatcagatatgagggagactcacagtacaattcattctgaggcaaactgctgttcagatgggaacctgtgagattgaacatgttgtgtgcttccaaaatacaagagtgggaccaggcataggatagacattcccattccaaagggagaaataggaaagaagaaattcataacaaatgcttcccaagtccaaaatccaacagagcaaacattaaatctttttttggggggtggggagtgggtacagagtttctctcttgttgcccaagctggagtgcaatggtgtgatctccgctcactgcaacctctgcctcccaggttcaagtgattctcctgcctcagcctccccagtagctaggatcacaggtgtgtgccaccacacccagctaatttttgtattttttttagtagagacaaggtttcacctgttggccaggctggtctccaactcctgacctcagtgatccacccacctcagcctcccaaagtactgggattgcaggcatgagccacggcgctcggccaacattaaatcttaagtcttaaaaataatcctctttggttccatgtctcacttccagacatactgatgtggtgaacctgtctccacagctttgggtggccctgctcccagggcagcttgatacctggcttgcatcctggcttcctggggctagagtcacacactggctgctttactgctctgggtcaagggagctgacctaccccagctctgctgagcgttgggcttcacagggactctctgtggtgcctcacaccctcggaggcttttgcactctgcgcctttataagggcactaattcccttcatgaaggctctgttctcagaacctagtcacctcccaaaggcccatatccaaatactatcaattgaagattagctttcaatatgtaattttttggggagacaaaaacattcagaccataacaaccctaatactatctataactacatttaatatactatgaactcaatacttcaaagacattgtcagattggattaaaacaaatgttctaatgcttacatgggacccacattaaatacaaagacatagaaagatttaaagtaaaaagattttttaaaaaaagctgttccatgataatattaatggaaaaacagttaatgtagctgtaatgatatcaaacaaaagtggccacatacagcaagtaggaaatggctgggcgcggtggctcatgccggtaatcccagcactttgggaggccgaggagggcggatcacgaggtcaggagatcgagaccatcctggctaacatggtgaaaccccatctctaataaaaaatagaaaaaattagccaggcgtggtggcaggcgcctgtagtcccagctactcaggaggctgaggtaggagaatggcgtgaacccgggaggtggggcttgcagtgagccaagatcgttccattgcactccagcttgggcgacagagcgagactctgtctcaaaaaaaaaaaaaacaaaaaaagagaaaaaagaaatagaaacctagttaaagatgttataatgataaaaggtaatatatacagataatattataattatatgtgatatattctatattataatgttaaatgtatgatcatttgataaaatcaaataacatgatgataaaatcattataattaggctatcaagatgaaagggtaaattccacaggaaaatatagcgatcttaaactcgtgtacccttaataaaacagcatcaaattatgtagtgaaaattggccagtcatggtggcttgtgcctgtaatcccagcactttgggaggccaaggcaggcggatcgcttgaggtcagaagttcgagaccagtctggccaacatggtgaaactccatctccacaaaaaatacaaaaaaaaagaaaattagctgggcgtggtggtgtgcccctgtagtcccagctactcgggaggctgaggcaggagaatcacttgaacctgggaggcacaggctcccaccaccacacttcagcctgggcaacagagtgagtgagactctatctcaaaaaaaaaaaaaagtaaaattacgtagtacaagttgacagcatataatgaaagcgtaagtagagaaattcacactcattaattgaaattccccccccccgtcctttcagtaactaatgagacagttagataaaaatatcagcagaagccaggcacggtggctcacacatgtaatcccagcactttaggaggctgaggttggtggttcgcttgagctcaggaactcaagaccagcctgggcaacatggtgagatcctgcctctacgaaaaatacaaaaaattagcctggtgtggtgatgcgcacctgtaatcccagctactaggggtgctgagaggggatgattacttgtgcccaggaggttgaggctgcagtgagctgcaattgcaccactgtacttcagcctgggtgacaaagcaagacccagtctcaaaaaaaaagaaaaaaaatcaatagagaaatttgaacaacatagtaagtttgactagttgacatatgtagagttttgcacccaacaagtgcaaaacaatttttcaagtacacatgaaataattagaaaataactatatactggggagtaagtttcaaaaaatatctatgaattgaagtcatattgagtatgttctcagtttacagtgtaattcaactggaagtcaacaataaaaaggctagaaaatctccaaacggttgaagatgatcaactatatacatacatgtgtatatatacacataaacatatatggacacacgtgtatacatacgtgtatatacacgtatatacacatgtgcatatgtgtatacaaacattcacacgtgtatacacacgtgtataaactatatacatgtgcatatatacacacatacacacatgtgtgtatatatgtgtgtatatacacacgtgtgtatgtgtatatacacgtgtgcatatgtgtgtgtatatacacacaagtgtgcatatatgtgtgtatatacactgtgtatgtgtgtgtatatacacgtgcatatgtgtctgtatatacacgtgtgtatatgtgcgtgtatatatgcgtgtgtatatatgtgtgtgtatatacacgtgtgtgtatatatgtgtatgtatacacgtatgtgtatatagttgatcatcttcaaccgtttggagattttctattatatatattttttctttaacattatatggtgttttatcatatagtgtttcttacggacatagcttaagaatcatctgttattttgtttcacagaaagtgtga

SEQ ID NO: 72 - DNA, 88582 bp, Homo sapiens
gcaagggttgaaaaatggtcaagcatctctttctaaatctattttagtcttcatgccttcaaagattcatattgtggctttgatggggagaatactgtttgtaccttgtacttacttttcaatttacgaagagtaatggtaaagagtatcaaaaaatttgatgccaatcttgattgatacacaattaaagatagagttctgagcatactaaaggatttcttataattgaatttaaacagttgttaaatcttagctaaataattgggatactacgcaaagaaaaatgaaaacaaacattgatacaagatgtattatgggctagtctctacaatagcttatcaaaaatcctaatcataacactatgagaaccctcattttccaaagaaaacaggaagagggtgggtgagtcattggcccgagattaattacccagttaggaagtgacaaaggtggggccaggcatggtggttcatgcctgtaatcccagcactttgggaggccgaggtgagtggatcaactgagatcgggagtttgggaccagcccgactaacatagagaaaccccgtctctactaaaaattcaaaattagctgagcgtggtggcgcatgcctgtaatcctggctactcaggaggctgaggcaggagaatcacttgaatccaggaggcggaggttgcagtgagccaagatggtgccactgcactccagcctgggcaacaagagcaaaactctgtctcaaacaaacaaaaaaagagaaagtgacaaaggtaggatgtcagtccagagtttggctctgagccagttctccactcttgtctgcacttggtattgtcactttttaagattttaaccattctgataagtgtgcactgatattctattttagtttacttagcattttcctaatggctaatgaagttgagcatctcttcaggtgcttgtttgtcatctgtatctgctctcatgtcctttgctcattttctaattggatttttaaatgcactgttgttttgagagtcctttatatattctagatagtagtcctttgttgcgtatgtggtttacaaatactttctaggattctttcttgtcacaatatcttgtcattcatgtttctaatccaccagcctggagatacattagggggagcaaaaaacccagattgcatctgattatttgtgagcaggtttgcagtgcagagtccacttcacagtcatcacttaaccatctaactgtaaactcgatttcatcttttgtgtacccaatatttagttagcattcttggtaatggttacaagtttgtttttacgttttcctaaaataaaacataacaccagacatgtgtaaggaatctggtgttttaatgtataataaatgccagtgaaagtgttgtattccttatttcctttaactcacccaaccaatggaaggtattaccattatctttatttcacagatgaagaaacctaggcctgaaaatgttaagtaactagcccaggttgcatggcaacaaaaataagatttatatcaggtatgaatcattcgagagacgcttagctgccactcaatattgtctcttttatattcgattttgttgcaaaattatttggctttttaagaaatcatgaagttgctatgtgtcatttactggggaagggctgagagaactgatgttaaaaacactgtggatggggccgggcacagcaactcacacctgtcatcccagcactctgggaggtcaaggcaggattgattgagtccaggagtttaagatcagccagcacaaaatagacagactccactctacaaaaaattaaatcagtcaggagtggtggtgcactcccatagtcccagctacttgagaggctgaggtgggaggatcactttgagcccaggagttcagggctgcagcaagctatgatcacgccactgcactccagcctgggcaacagagcaagaccctgcctctaaaacaaataaacaaccagaaaccccaccctggatgtacttccaattccagccattgatggaataagagggattcaatttgccctcaggtctattttaacaaagaggctcaaaagtaagcctaaaaaggatcaaacagatttcaagtaatttaatgaaatatttcttggaataccaaaaagtccaacagttaattacataaaattgacaacagtggcatctatttataaattaccaggcacagaaagcaataaaatctgtcccaatgccaaacagaaaaaaaaaaaaaagacacagctaatagaatcagcaaagacagtaaagcagttattaaaaatatacttcatatgctcaagaaggttagagaaaagcatgagcattatgagaaaaggagcatgtaaaaagatccaaattaaacttctagagattaaaaatatagagactgggcacagtggctcaagcttgtaatactagcactttgggagaccaaggcaggcgaatcacctgaggtcaggagtttgagaccagcctggccaacatggtgaaaccccgtctctactaaaaatacaaaaaaattagccgggcatggtggcggacacctataatcccaactactcgtgaggctgaggcaggagaatcacttgaacccaggaggcggaggttgcagtgagccaacatggcaccactgcactccagcctgggcaacagagtgagaccctatctcaaaaaaaaaaaaaaaaaaaaaaaaaaaaaaagaaaaagaaaaaaaaaagaaaagaaaaagaaaaaaaaaatatctgagatgaaaaatacaccagatgggataaacagcagataagatactgcagaaaaaaaagacttgtaaaactgaagacaaaacaactgaaactaaccaaaatgaacagaagaaaaatatctgaaaaatgaaaagagcaacatagtgtggcctaaaatgcatcacacatatagtctcaggaaggagggggtggcagttcagacaaaaatttttttgaaaaaataatggctgaatatttatcaagtgtgaggaaaactataaaccaaatagattgaaaaaaaaaaactcaagaaaccaaaatcaaagaaatatagaaaaacacaactaagcacatctcactaagaagcaaatggcggccaggcacagtggctcatgcctgtaatcccagcactttgggaggctgaggtgggaggactgcttgagcccaggagtttgaaaccagcctgggtaacacaaggagatctcatctctacaaaaaaataaaaatttagctaggagtggtggtgcacatccatggtcccaattgcttgggatgctgaggtgggaggatctcttgagtctgggagtttgaggctgcagtgagcctggatggtgccactgcactctagcataggtgacagagggagaccctgtctcaaagaaacaaacaagaagtagatggcaaattaccacgtatataaagatgttcatgattattaaccaacagagaaatgcaaattaaaatcatagagaaatcactccatacctactaaatgctaaaattaaaaagacttccaacaccaaatgctggcaaagatacaaaacaactgtgactctcattcctggtgggaatgcaaaatgatacatctactttggaaaaacagtttgactgtcttgtaaataccatatgactcagctgtcccactcctgtattttgtcaagagaaataaattcctatgttcacacaaagactagtacagacagatcttcaaagcagctttgctcacaatgaccaaaaactggaaacaatccaatgtctatcaacagatgggtgaatacatacatagcagtgtagccattcaaaggatttggttttatcaaagaccagactgcagactccagcaacagggcagaagaatcaccaaagcattatgctaagtgaaagataaaagcactccccttaccctactcaaggttacatacttacatgattccacttatatgaaatttgaggaaagagccgggaatggtggcttttaatcccagctactcaggaggctgaggcacaaggattacttgagcccagaagttcaaggctaaaatagagaaggccaaggtaggaagctgagatctatgatcaggactgccagtggcaaggagcactagtgagatgtttaagctgaaactgtgaaaacaattggtaggcttgcaagggtgaagcagggtttgttaaccttctcaggtgatgcagtaagccgtgggacaagagttgttaagagaactgcaagtagatcatgacaataaaacaaatgtttaggaagaagaaaatgcaaatacagatagttgaagtgctatgacagcagtaaatacttggactgctggcttatggcgcatttctttcacatgtgcttttctggaagtattcacaaccatttgaactaaaacatttggattaaacttcaaaaataatagtgttcaagtaaatatatcgcctctcttaagacactagtcaatcaatgatataaggattaatttagcatctcatttcttaggtaaaaccagacaggatttcttttgggaccagtaaataactgctatcgcttctcgaccttttgtctaagatcaagtgtctaaataattgctaagaacaattctgattttttttttttttttttttttttttgagacagaatctcggtctgtcgcccagggtggagtgcaatggcgcgatctcggctcactgcaacatccggctcccgggttccagccattctcctacctcagcctaccgaatagctgggattacaggcgcccgccatcacgcccagctagcttttgtatttttagtagagacggggttttgccacgttggccaggctggtcaactcctgacctcacgtgatccgcgcaccacagcctcccaaagtgctgggattacaagcgtgagccaccgcgcctggccgactaagaacaattctaaaggtaactgcttttgacaaattggaaacctaactcacaacagcttgtttttctggattaactcctttctatagaactctcctaagtgtcgattttgcaaagatatttctaaatcagatttgcctaattatgtttatgtgtacccatgcagacatactgaaagactaagaaatgtcacagcacaggacaaccgaagcacttgaagaaatttcaaatattcttaaaagtatgaattccaatgacagaaaatgtatttcatttgtcaaaattcttaatttctcaagttcaaaaatgccttggcacatttccatggctcctcgctagaagaatttaacttggctctacttccaggtttgtaaaaagaccattcacagttaattctattttgaaaacttttttagtctgagtatgctttaattgacggcttagtcaatgagctttcactttaaagaatagttttatatgaaatctttttgtgtgtgactttgtctccctagcattatttgagaattatcgaattcacaattaaataaaataatctacaagaaaaaatgtttctcaaacatttctatttttaaaaaatcattgaatatcaaagcaaactaatgctcaaaaaaatgaccaaacaattgcttgatgatattgtgtcatataaacaaaacaaaacaaaatgaccaaaccattttcacttttctatgctgtcaaaaaatcaattcagtactttttgtttagcatttgaaatacacaacgactgctaagaatatcacaattaccttgtcaaagtctagttcttatccttccgtggtggaggtagaggcggacgaaagcaaatgctgtagaaacgttagttctaagttcagaataaacacctcagaactctcttccttaaatcctttttagggtatttatgcatttgccccacctctggccatctaatttaaatttaaaagaaggtcgggtgcggtggctcaagcccctaatctcagcacttctgaggccgaggcgggcggattacttgaggtcagaaattcgagatcagcctgagaaacatggcgaagctccctctctaccaaaaacaaaaaatagctgggcgtggtgacgcgggcctgtggtcccacctacacaggaggctaagatgggaggaccgcttatgcccacgaggtcgaggctgctttgagccagcctggacgacagagcaagacccagtcccaaataaataaataaataaataaataaataaataaataaataaatgtaaaagaagacaaaagagctttttggtcttcaggtaggagttaattccgtttcccaggagataggatatagatttattatcgcgggagaaaccgaaagagtctcatcacgttatgtagtagaatagatcaagattgattcatggactcagcaaatagttattggggcgcttctcggttccaggcagtactaaaagctagaaatatgaaaaataaataagtacattcaaccaagtcttatcctcaaaagaatttacagttgtgaagagggaagtgagaggaagcagtcagtacaattcattgtgagtgctgtgatgctcagcagcattgggagcggtgcggtctccggagggacagccacctactctttgaggcaaaacaaagcgtagagaggtggcaggtggggaaggggtttggaaagggagaggttggcaggagtctccctctaagcaaactgaaaagccagagaaactggcctagatagaagaaaagcctttttcaggccaggcgaggcggctcacgcctgtaatcccagtactttgggaggccggggctggtggattacctgatgtcaggagtttgaggccagcctggccaacatgatgaaatcccgtctccgctaaaaatacaaaaattagctgggcgtggtggcaacacgcctgtaatcccatctactcaagaggctaaggcaggagaattgcttgaacccgggaggcagaggctgcactcagccaagatcacgccactgtactccagcctgggtgacagagcaagactctgtcttaaaaaaatatatgtatatgtacatatatatatatgtagaagaaaagcggccaggcacagtggctgatgcctgtacttagcactttgggaggccgaggtgggcagatcactgaggttaggagttcgagaccagcctcgccaacatgacgaaaccccgtctctactaacaatacaaaaaagaaaaaaaaagatcggggcatggtagcaggcacctgtaatcccagctacttgggaggctgaagcaggagaatcacttgatcgcagtaggcagaggttgcagtggctgaggcaggagaatcgcttgaactcaggagacagacaagagcaaaactccatctcaaaaaaaaaaaaagaagaaaagcctttttccctctaccttgccccctcccacaagggccagtgtttgtgaaaattaaaagctgtaaaggaaaagagaacaaggcatcactgagagttaagttttcaccctagagggttgtaggtatgacataagggaaaagaaggcaagattgtgaagttacttatgacaagccgaatggttggggagccactgaaggttttgttttgtttttttaatcagagcccccccacccatgtctaaaggtttttaaaccggctgataacataatcgggttagcactgtaagaagtttacactgcaccccaccccgctcatactcagagcttagatttgggcagaggctaggacactgattactgcatagataataattacaaccatatgaccagatgaaaataattaagagaaattatagataagtggagagaagcagcacaagatctgaacccctgagtgacaggaaaaaaacatgatgcttttcctgttctcagatacaagtcacttgacccacttgacccttcacttctttttatttttttttttgaggcggagtctcactctgtcacccaggctggagtgcagtggcatgatcttcactccctgcaacctccacgcccacaggttcaagcaattctcctgcctcagcctccctaatagctgggattacaggcatgcactaccacacccggctaatgtttgtatttttagtagagacagggttttgccatgttggccagtctggtcttaaactcctgacctcaagtgatctgcccacctgagcctcgcaaagtgctgggattacagacatgagccactgcagccggccgacccttcacttctgataccaggtatgtgggggttccccccacacaccaaacaatcctcagcaggcaccaattaattaattgaatttatccagttcaattctgacattgtctacctagagatagtgtcagatcacacaaattgagagctcagttccataatactgccccctactttagatggcaattccaagttccagattgtaacctgtgcttctgacagaccagttataaattggaattcccatgacccactcttcaggttttactaatttgctacagtggctagagtgggaatatttacccatttcttataaagaattttacacagaatacagacgaatagcctgatggaagcgatgcatagggcaaggtatgggaggagaggcatggagcttccatgtcctctccaggtgtgctgccctccaggaaactccacgtgtttagctatctggaagctcatccgatcctgtccttttgggttttcatggaggcacgactgactacatcactggctactgatgatgaactcaatcttcagctctctccccttgtgggaggttgaaggtgaagtggggctgaagttgcaactctctaatcacatggttggtttcccctatcctgaggccattcaggaacccaccaaaaatcacttcattaaagcaatagatgctcctgtcatccaggaaataccaaaagatttaggagctcagtgtcagatgctcgtaccactcaggaaattacaaagtcttagaagctctgtgtaaggaacagacctccaatatttgtcaaagaccaaatattagaacaaaagattctcctagtgcccctaattccaagagctttagcagctctgtgccagaatgggtcaggtgcaagtggctcatgcctgtaatcccagcactttgggaagcagaggcgggaggatcactttcaaggccagcagtttgagaccagcctgggcaacatgcaagaccccatctcttcaaaaataaaaataaatagaggttctgtgccaggaatcagaggtcagagaccaataatatatttcatattatatcacactttcacaaccccaaatctcagagacttaaaacaatagaaattgatttctcactcatgccgtacatgtattgcctatttggcaaggatgtcaggctctgtgcattgtagttcatcagggatccagcttgactgtacagctaccatcttcaacactgctggttatcataccagggcaaaagacagttctggagtgacacacatcattttgcacttaactcactggccagagcaaattacttgaagacgccgaaagcatgaacctccatatacacagagggtggaaagacctggaagtatctggcaaacatgtgtttgatgaccagaaagcattttataaatgatgcccatttatcatttcctttctttctttcaattgaagacaggcaaggtcatttgttgagagtaatggaggaggtagaggaggttgaagaggaaggattaggtaagatattgtttattctttttccaagtgtttaagtgaatattactagagaaaagtaattgttgaatgcccatttacgatttatagtcatacatgtagtatgacatccatcagtacaactatgggttgattgacattgatctttagctgctcaagtgaagattctgagtaggcagataagtgaaagttttactatgcaattatgatgaagggtgagtggacacaggggttaaaattgcttgcaagggagagattataagggatgatggaccatggttgaaacaggtcattgagtgactcagttattcttaagtagtacatttttcctctgtaaaataaagaatgattcggtacagttaataccatcaatcaaatttgtcagtcatgaaggatgtttctttggttgtctacccagaatgtctcctgtctcttagaatagtcagcttcttctttggataaattaaaatcccactccaaacttaaaccatatggtcacaatgggagtgccctccaccacacattaccatttatgattgggtagacctcttacctgaacctgagtccatttcatttcctcactttctggccacaagggcaagatgtcctcaaccaggcctatcaaagtccttccctggggtccttttaactggatgtcagatgatagggtctttttcttcactgacactgaggccatgaggaggtgaggtcagagctatgcatggggcaactcactgccttgaggagaagtttggagagaactgacttggcagcagatgtgagatgaggggcaaacaaattctcacccccaccagtctccacatcctactcagccccatagccacgtctcctctgtccttctcaggttttgattatgcaaacctgtaaatttcctactttgagttgtatataaatgtaatatataattatattataattctaagtaggtgaaaatcatccatcaagaacctctgctctgtgccagctctgctaggaacagggaaaaatgggagcttggcagaagaaaatttttcttatttttcatttccctattgtcctgctggaaaaatacattcacaattaaaacatagaaataggaacatgtttataatgatagagatggcacaaaaaagcaaatgatgaattccttcccaaaattatcccctaagagttaagctaataacattcacataataggaatcataacagaaccactgaaagtgtcgacttaaacaacagagagaggctctctaaaaggaaatgatatttattcagaaatacagcattgcaatatcaactatgtgcatattccaggagtaaagagggattttaggggcagagcatggtggctcatgcctgtaatcccagcactttgggagctgaggcaggtggatcgcttaagctatctaccaaaaatacaacaacagcaaaaaaattagctgggcatggtggcatgtgcctgtagtcacagctacttgggaggctgaggggggaggatcgcttgagcctaggaggtggaggttgcagtcagccaagatcatgccactccactctaacctgggagacagagagaccccatctcagaaaaaaaaaaaaaaaaaaaaaaaagaaggtttttaaaggaaaaatgaggaagactatataattgttttgagataattatccttggctccaacgatcaatgatgaacatggcacgaatctgaggctggataagcagaagctgggcagatgtcctcatagctagtgcttcttgtgtgaggttgtgatggcctttgtgcaaggttgtggctttgcagagtcctttgtgctagtttttgttatcagtaatttgtgcatgagaaccctcctttaatggcattcctggatcaatttgtcaatatatatatattttttaaacatgagtagctccattttgatactgacaactttcatgtttcccccttttgatcaagatctttctttaaaagcatcactgattaatcatcctgtagttaagctctgattgtcccttgatacctgggattaacctgttctgggtttctggtctcatcccacctgggaggaagtgattgatggctaggagtcagtgtcaaaatactttagccacatttgagcaacaggggaggtttgaagggacttgctcttcgacttagtctacctagagtccatttttaggttcaattttgtttgttctatagtctttagctatcaactcaaaacctgtgggccagcattattctgataggagttggattcctgaggggttatttgatcctgtttcgtgtaggaatagtaggtgtagggctgttagggctgtgataataaaagataggataaagtggaaagtgaagaatcatgtgagggtgggtttgtctactgaatagccacttcagactcactggaccaggtctgctccgacatatggaatggcagatagtaagtttgtgattactgtgtatttctgtaaaaacttaacaagttacagatacaaagcttaaaaagggaaaataaaaaataaaattaatagtaatatgacaatcccagttttcataatggttttgagccatgaacctaggcttaaaaacaaccaattgaataaatcaaatgaccattgtcctatcaattgaaaaaggtaggcattagagtgaaaaaggtagggatatgagtctcattatgatacagaatgttgctcccatatcttgggagaagttgtctatagcatgaaaacatcaacttctcctcctggtttgcagtttgaatggctctggttatggcattgggtagttggtgaactttttgtgtgatccatacatcaggtatgagacttgttccttaaaattaatccaatatcagcttataaggctttaggaacagagcagttcccatttttagtaattccagaatgtaatttaggatggatttatagttttataacctttatgtcaaaccctgacaccttaaaacattagcagagaaaatataaaactctgactagtaaacaaaggcaaaaatgtatgctgagaattttaaggacatttctatttttattttactattttaaaagtttttttaaatcaaagatgtacttaagtcacatgaactaaaagccatttggattaattactatatattttatatgagcactcacttatctaagccattggcctagataagtgtaataaaatatacagtaattaactaaatatgttatttagcaacaaaatatatagtaattaacccaaattcttaagggatttcaggctgactttgccagattttaccatgtagacacaacttataacgtaagacaggtacatattcataaataaacctagacatataaaacatacaaacaaagattttataggtttcattttagaattttgagacagtaaaacatgtgaactcactggtttacaaaagacagttgtttccaaattatatttctgacagaataggacatgttcacatagctaaaactttatttgcctcaatagataatctaataaaagctgtgaaccaaaatttctggtaaagaagtttggttttaaaaacattttggtcaggtgtggtgtggtaatccctataatctcagcactttgggaggccaagacaggaggattgcttgaggccagcaattcaagaccagtctaggcaacatagtgagactcccatctctataattttttttttaattaactgggcatgatgcaacatgcctatagtcctagctgaggcagaaggatcccttgagctcaggagttcaacggtgcagtgagctaagaaggtgccattgcactgcaaccagggtgacagagtgggaccttgtctctaaaatatataaaatagcctggcgcagtggctcacacttgtaatcccagcactttgggaggccgaggcaggagttcgagaccagcctggccagcatggtgaaaccctgtttctactaaaaatacaacaattagctgggcttgatggcgggtgcttgtaatcccagctactcgggaagctgaggcaggagaatcccttgaacctgggagacggaggttgcagtgagccaagatcacgccattacactccagcctgggcaacagagcgagactccatctcaaaaaaataaaaataaacataaaataaaatatataaaataaagcaaacatttcctttaccaccaccccctttttatttttttagtttcaaataagttttgctaggactggctggcttaactgtataagaaaaacaaaatctccaatagccttgaatttttagtaacaaatctatcttttgtttgctggtttcattggcttgactagtcactgcaggtagggaagcattaacaatttttacagcttttttagaaaaatttaatctttgatggaatgccataaacagtgagttttatctcaacatcagcgaaaaaaatcagcagattcaaagtaggcagagaaaaaagagtgatagagaacttagctctatatggtaactcttatcattgcaggttttttagagttccaatcaggaccattaaatctctgaatttttcttgatgtaatttgcccattgattttaaaatgtacacaagaatgggccataatatgtaaccagctggagtccagagaacttggcatgctttaatgtttgggaatcccattctgtttcttattaatctctcaagagctaagacaatcctataaattctgtcagagaatgccaggagtttagttcagtgtttagacagtggcagccaccctagtggtagtttagccaccctgctcacactatttttgtttacttttgctcttggaagatttttggatacaagcaaggaagaagagccaaattacttacagacacatacaaccaaaccaaaatcaaagtgctcacaaaaattttaacccaggttgtgcagatcaaataaaatgttaaatgagtcatgcagaaataataaaaagtaaaacaaacaaacaaactaaacctcgaaggcaaattcaccagaaaagacatgcctcagtgacagaacataaattttgtagaaaccagagtactcaaaccaggacacttgtctttataccaaaaaagacttggcagaagagacaaaaagtattttattataccagaagggatgtaatgtcctttattgaagatggccttataaccaaaataaatcctgaataaagtaaaaaaaaaaaaaaaaaaactcaaaatgagggagactttgcctgacaaaagactcaccaaagaagagaaagtaagctgtggaagcagagagctcaaatggctcaagtgagtactgcacactggttctaagagttgttgattccttcagaaagtgatcttgtcccaggtctgcttctgggcaccatttcagactacccaaataaacagagaaggatctctaaaataaatactattggttgggcatggtggctcactcctgtaatcccagcactttgggaggccgaggcaggctgatcacctgaggtcagttcgagaccagcctgaccaacatggagaaaccccgtctccactaaaaatacaaaattagctgggcatggtggtgcatgcctgtaatcccagctactcgggaggccgaggcaggagaatcacttgaacccaggaggcagaggttgcagtgagccgagatcgcaccattgaactccagcctgggcaacaagagcgaaactctgtctcagaaaaaaaaaaaatactatttattcctgaatagggcattgcagtgggaatatgcacatagtttatcatggtttactatggcacatgtattactatcacaatgccatattcctaaataaatacctttttttttgaaaaagagagctctgtttgacatgtagattgacaaaagcaattgcaaagagacagcatgactgtggcctgaaaaacttttctaatgctattgtttaaaactgttttaatgaaacctaaaagcatatacaggccgggtgcggtggctcatgcctgtaatcccagcactttgggaggctgaggcaggcagatcacttgagcccaggagttcaagaccagcctggccaacatgatgaaaccccgtctactaaaaatagaaaaattagccaggcatggtggcacccacctgtaatctcagctactcaggagggtgaggcaggagatttgcttcaacctgggaggcggaggttgcagtgagccaagatcgctccactgcactccagcctgggtgatacagtaagactccgtctcaaaaaacaaacaaacaaacaaacaccaaaaaacatatacaaaaataaagcgaaaactacaatgtatagccatatatccctgaccctgaccctagttccacaattatcaagattttgcacccatttgcctctagccttttttttttttgctgaagtattttaaagtgaatcctagtgttacagcatgatacccctacatacctcaacatgcatcactaacaataatggacattttcttacttatctagtgattaatgtcaactcaaactcttaacaaccctgaaatataggcattattcttcctatttttacagattagaaaaatgcctgaaagaggtgtatcccatgagatgaccaacacatggtcatctttctcatgacctttcctcatggagattactttctaatcgggtgatataaaacacacaaatgaatacataataaaaaaggtcattatggtatgtgaaaaatggcatttctttttaccccatcctaccactctgtttaattcacatgaaacaaggagaggctgcctcacttacttctccttccttgtttaggggtttcctatcactttcctgttgaatttcagtgttctctcttagatgatctatttgaggtgtgattatctgcttgttattttggttcttctttgtggaggagggtggcgtgaaaggcagggtgggggctggggataactttgccccttgggcataacctgccccttcccaccacctttatgcccacatgcaccaccaaagggcctgagtacaggcccatgggacccagctctacctctcccagtgtccaagcatgccgtccaaggggcctgggaatcactgtgtataatccaccattgttgacacctaagcactcctcccaggggctgaggagtggtccaccaacttgccactgccactctcagctggcacttacccatatttgctacctgtgggcctgggaactggcctgcccagcctgtcacagccactgccaacaccaatacaaaccactagggagccagagagttgttccaccactgctgctgtcatctctcatgccatgcctgctgcccaggtccaaggacccacccaccaacatggcctgccactactgttgccagcactcaaacaagctttctgaggctcaagaaattggcctgcctggacaacataacacaagtgctaacatatgccaccctgaggtccaaagataggcatgtgctgtgcccaccactgccaacactggggccagattactggccaacctggtgtacccatccccagcaaaatgtcaccggagccaccactagcaactgcaccctaaacagctgagttaactatagaaactatttaagctgtttatagccaaagaaactatatggaaactttactactgcatgtgaccagaatcaaagccaaagtgtcctacccaaccaacatcttcaggaaaaacaggaggtgaaagacctctagaaaggaaattacaaaccactgaagaaagaaattgaagaggatacaacaaaaggaaagacatcccatgctcaaggactggaagaacttatattgttaaaatgatcatattatccaaagcaatctacaaactcaagacaattcttatcaaaataatgtcatttttcacagaaatagaaaaaacattctaaaattcatatggtactgaaaaagagtctaagtagccaaagcaattctgaacaaaaataataaagctgaaggcatcactctatctgacttcaaaatattttacaaagatgtattaatcaaaacagcatggtattgatctaaaaacaaatgtctgtgtctccacatagacatatggaacaaaatagacaatgcagaaataaatctaagcaataacagtgaactgatttttaagaaaggtgtcaagcacatctactgaggaaaagacaagcttttcaataaatggagctgggaaaactggatatccataagcaaaagaatgtaactggaccccgtctcttgccatatacaaaaataaactcaagacggataaaagacttacatggaataccccaagctataaaactactggaagaaaacaggggaaacacttcaacacattggtctaggcaaagattttataactaagacctcaaaagcataggcaacagcaacaaaaaatagacagatgggactataaactcttaactctaaactattaaactaaaaagctctgcacagcaaacaattaacagagtgaagagataacctgttgagtgagataaaatatttgcgaactattcatccaacaaagcactaatatccagaatatacaaggaacccaaacaactcaacagtataaaaacaaataatcccagtgaaaagtgggcaaatgacaagtgtagacatttctcaaaagaagacatacaaatggccaaccggtatatgaaaaaaatgctcaacatcactaatcatcagagaaatgcaatgaaaaccacaagatatcatcttaccgcagttagaatggctattattaaaaagacaaaaaaaaaagatgctaacaaagatgcagagaaaataacctcttatatactgttggtgggaatgtaaatcagtacagccactaagcaaaacagtatgaagattactcaagaacttttttagaactaccatacaatcctgcagtctcactactgagtatttatccaaagtaaaagaaatctgtatattaaagggatacttgtactcacatgtctattgcagcgctgttcacaatagccaagatatggaatcaacccaagtattcatcaattggcatatggataaagaaaatgtggtatatatacacatgatggagtactatttggccataaaaaagaatgaaaccttgtcatttgcagaaacatggatggaactagaggtcattaagttaagtgaaataagccaggcacaggaagacaaatatggcgtgctctcactcacagtggggggctaaaaaaaagttgaactcatggaggtagagaatagaatgatagttaccatagactgggatggatgggtgtgcattgggaggtgcaggggtatgaggagaggttggttaatgggtgcaaaaaatacagttagatagaagaaataagtaagttacagtgttcaatagaagagtagggttactataattaacaacgtgttgtatatttcacaatagctagaagagaggtttaaaatgctcccagcacacagaaatgatcaatggtcgaggtgaaagatatcctaaacactctgacttgatcattacatattctatgcatgtaacaaaatgtcacatggaccctataaatatgtataaatactatgtatcaataaaaataatttaaatatttgaacagcaatacaaaagaaatatcttatttttacatttggaagtttaaaactttattttctttccatatccctagaactagtcctaagctctaggcaattcggaccaatctaaaagaaactattgtgtgttaaacatgactgaatgttgagtgatggttgaagaggccaggtgtcagatttgtgtttggcacaagcctcaaaggaggtatttagctcactttgtatcttcatagtacagagttttggctgtttccaagtagtatatagtttttggataaatggtgttgaatgtaggcagttgtttacaatgctatgtctacatcatgtgaaatctccagatatctgtaagcaaacagcaatctaagggaaattttctgctttttcctggatatttgacatcatgtagtctaaatctggcagtctcctaaatacatgtcttctttcagaattctatattccatgtttttctcatattacaacagcagctaagacatgtcagtcactctccttgttcttggagctatagtagctcttgcaagtgaggttgattttgatgtatgataagatttctagacatttcaaggggatagtataatagctaacatgattcaaattatagtttcatcctatcatgggaactatatatttttaaatagaaaaagtataaagaatattattcaccatagtttgtaaataaaatctgtatggatagatgtattgtttcccataagagttatggtcacattagtaaatggagtgattctagttctataaagctgtagtgaattattgtaattttgtgctgccttagcaagcattttgaatataagttggacttcctcatacaaaaagcaaggcttagttgcccttaacataataatagtttccagctctccatatcctcccatttcctcaaggttgttgatgtagatatctgccctatacaactgcctgtaatgtgacaggtcccccaccttgattacttaagggtggatgtccgctgcttactcgctgaaggccaagcagtgaaccaaggccagggtgtccagttgaggttcaggtgcccctgagaacccaaacatccccgggcataggtaggaacattccaaggaaaacagtctcatcacacataggcagtagccaaagagccagatcattagcttgaaagtagcttggagatggatggtgacatggatttctaaaaatgtcctgctgccactcaggagtgcactgtatgtaagtcctaatcaattcatctactcgccaagctggacttactcaaatcattctttttgtctcttggctccttcccagtttgggaagggacattacagatttttctcataacaactggtgtcactaacctaggatctaagagaccaaatgatgaatcaggaaggagcatctgttgggggaatcacagggtagtcagaggcataaatgtggagtggagttaccccactgctcaacctttgtgggccactgtgtggggacagggatgctcagacaacaccactggggactgagtacctattacaaaaaactaagatgttaaaatatgatatggacagcaaatatgccatgtggtaaggtcggctactgagaaattgttagagcaggaaaggaaagaagggtagaatttcctgtggcttacacatttaaaaagatgaaaaagttcaaagccacaacagattttctaggactccagctggatgcaggcccatccttgcacacagtttttaactgatgggcaaattacagcaagaaaaaaattcaaagctcaaatgattaacctgcaactatacagttaagtagagtcttctagatttctctatttctctcttttcttttttgcctgctttgaatctaccgttattaagctacttgtgttgagataaaactcattgtttatggttttgctaattcaacgctacatggacattttatttttcttattaaattcagccagttccagctaaaatgtaaacattggaaactcctatgaaactgcagaagaaaaggtaaaagagcttttaaaaaatcagactgctatggaaactgctttactccaaattttttttctttccttggattatttacagggggaaacaaagtttagccatgtgacaggttgtaatttagtcaaaaataatttggatcctgctatctttttttttagagatggagtcacactctgtcgcccaggctggagtgcagtggcgtcatctccactcactgcaacctccaccccctgggttcaagcgattcttctgtctcagcctcctgagtagctgggattacaggcacctgccaccctatctggctaattttttgtatttttagtagagacagggtttcactctcttggccaggctggtcttgaactcctggcctcggatccacctgcctcggcctcccaaagtgctgggattacagatgtgagccaccgtgcctggccagatcgagctatcttttaagctaatgaatttatgctgctgtctcatgactagagttttgaaactattagatcttttgtgcatgtatacatatttaaatgtatttatgtgtatgtacctgtattatgttatgcattgtgtctatcatgctactaaattgtcttataagtaagtgattagtcatacattaagttcaaatgcttttcaagttcacatgaatttagtaaactttaataaataagctggctttaaaattactggtaaactaaaactaaaaattgtcttcagaattgccagcatacatttttgtctgagcttactgattaggtaactctaatatttgctctgttggatttttttttttttttttttttttgagacaggttctcactctgtcacccagcctgcaatgcagtggcacaatatagctcacctcagtcttgacctcctgggctcaagtaatcctcccacctcagcctcccaagtatctgggactacaggtgcacgtcaccatgcccagctaattttttaaaatttttattaaagatgaggtcttgctatgctgcccaggctggtctcaaactcctgatctcaagcaatcctcctgcctcagcctcccacagtgctgggattactggcatgagccgccatgtttggctgcttccgctagatattttaaggtgtcagggtttgataagaaggttttaagactataaacctagccaaaaacatattgatttttgtttatgtaggtttttttttttacaaatatgattaatttaatatgaacagctaaattttctgagttattggcaaaaatgcccatgtatccaactttaatgttctttcttcagtaaacacctgatagtcacaggctataaaattggttaacaggaaaataacttagaatcatgattagcttctataatgtctcagttctcacgggaatctaggtgaactgctaaaaataaaagaattgggtaaatgtaaataagagaaatgcttgtaggcaagctttttgtgtaatttaaaatcaaaattattttaggtactcattgaatgtttgggtcatttccaattaaaaagggttataatatggggcattggttacacttttgagcttgttcatgaaatctatcacggggaaaagtattagcagacttcactgagctgaataaaagtaaggactgagtctagaaaatattcaaaaaataaaaacgggatgggccaaatgggtgcctgtatacttgtcctggcccaggcgggcaatgaacatgaaacaatactgccagggaaacactgaagtcatccaaacaatccagaaattacataagacacaagcagtcaggctggcccagtgctcttacaccagccccgtgtggcctgtgaaaaagccaggtggcacctggtgaatgacggtagactactgtgagctaaaaaagtggtgccctctatacaagcaactatgcccagtgttgctcagctgctacagcaggtggtccttaggctgggaaatgtccatgctgtgattgaattgactaatgcctttttcagtattcctttagcaaaagattcacaggaccagtctgccttcacttggggggccaacgatgggctttccatgtgttaccataagggtacctgcacaggcccaccatctgtcatggtatgattgcataggacttctctagactctctttgcctgccttgatctccctttttactatgtcgatgttatcatcctaacctcagaatctcttgctgctctggaggcttccctgcagactgtctttggccagcctagaagacaggggatggaaagtcaactccaaaaagttttagggatctggcaaggccatcaaagtcctgagagttacctggttgagtaagatgtaaaacacacccagagctatcattgataagatagcacagcagcctatttcctagacgataaaataacttcaggtttttctaggtttgctgggatactgaacaatattcatttctcatttggcacaaaccctccactcattacacaccctattataaaaagctgaaaagtgggactggacacacatagagcaagaggcttttgccaaagtaaaactattgggaaagcaaacccaagcactaggttccccactgccacagcaccctcttgtattagaagtcactggagatgccacagggatgaattggggtttgtggcaaaagcaaccaatggaaatggtagctgtagggcttggatctcaattatggaaaggagcagaatcttgctatacagttttagagcaacagctattggccatacatagaccattgcaacaagcggaggccatcaccagaaagcagaccatcacagtaaaaactgccactcattcaagagtgggtgaaaggcattctagctaagcctacctccagggtgacacagtcgcacctatctataataaaggggtgccgtgtcaggcctgtaagtcctttaagtcaggcactgcaggaggtgcttggacccatccactttaaacaagtagaggggactggcatagcaatggaaccacctaccaggccaaccactgtgtccgaagggacctgctgagaccctctagggcccggtacactgatgggtctagcaaaggcaccaacaccaatggtcaacagttgtgatgcaaatggagactgacaccatatggataaaatgggcatcagaacaaaacttagaccagaggtccacttaccatataacccaacaggcacaggcatcactacaaaaaagaatggcttgctgaaaacccaattacatgcactgtcccaattccatgcattgtttttaacccaagtacatacttaaatccctggactaagaatctccctgaagtcacacaaaggttagatgagtcacccactaccacacatggcatcatatcctgtgactggttggcacggactgtgaaacagacctcataaactctcagggttacctctgagtcactgagtcatgctcctgaagcaggtggtcagaccatgctcctgagagcaccaatggatctgctaaacataactggctatgtagatctgaagttgagctggacagtgcctccaaactggatcagttttatggcactggagggtgccatgaagactgctggaggggaggtggtcacagctgtgctccttgatggatatctgagagccttatgataccaacacgcagcagcaccaatatctgctggagtgctcacagggcaggcagtataggcaaggctggaaacttaccaattggctagtatgcttgctcctaaaagggaagccatgtgtggtacggtaagccaggcctgaagcccattgtgacctctctaataaggcccatgaaaaaaatatagtggtaataatgttacaagaagtggatacacccataagggtccctattaaatacctgtgttcacttccataggctgttgctcctactaaccatgacagttggtaatgccttcctggactgggctgattatagcagcagccagcaaccagtctgattgtagcatatatgcatacctccctgctgtcaaataataataatatgccttgaaatactctgcatttctcccaatggaactggagtgactgattcaacagaacgagtaacgcaccttgggctcagtagggactgcatccacctggaggcccaattgccaaagtgatggagacccaacaacatacgcctttatgggcactacctgttgagcctatatccttgataaagagaataatgttacaaatgcttttttttttttttgagacagagttgcactctgtcaccctggctagagtgcaatggctcgatctcagctcactgcaacctccgcctcctgggttcaagcaattctcctgcctcagcctctcaagtagctaagattacaggcatgtgccaccgcacccggctaattttttgtatttttagcagagacggggtttcactatgttacccaggctggtctcaaactcctgagctcaggcaatccacctgcctcagtctcccaaagtgctgggattataggcgcgagccaccgcgcccggcccacaaatgattttaaatcatttgtcaattcagatccatgataaaacctaattagatttctttacctcattctcaattggttatacactttacctactcattggagttatgtcttgctaataggcatgatcactgtagttagcttttgcttttgatgctgttgtgtgtactgtggatgtgacttgtacacacaagccaatgctatagggtataggcccatataattctttccctcataccccactcagagactgtggtccaagattggcagaaaaaaaatgtgagagttgagggacagggtggattgtagtgtgatgggtcccccatcaggttacttaagggtgcatgtctgctgcctgaacctgaaggccgggcagtgagtcaaggtcatggtgtgcagctgaggagcaggtgtctctgagaacccaaatatcccagggcatagctgcgaacataccagggaaaacagtctcatcacacacacggaaggcaaagagccagaaaattagctgaaaagcagcttagaactgggtggtggtgcagatctctagagctctcctgccactgcccaggagtgtcctgtatgtcagtactaataaactcatctacttatcaagctggacttgtgagagtcattctctgattatcttgactccttcccagtttagggaagggacattacaatcccaggtttttcttataacattgcctcctggtgaccacctcactatgagacagctggatccagcctacttgactggcaccactgaccccctggactatgcagttatgccatagtgaccaagtcacagccacagcatgactccctggaactgcgtctgcttactttaaactcaccaagtagaactccctgggggaaatctgcctgggtaatgccctggatcccagtaaaggcttcagcccacaggtccctcacacgcactctctctttgtctctctttctcttgttctccacccacaatctgagtgtacaagtcccagacagctttcttcttcctgttggccctgtgaggtgtgctgccttcttctctgggagaagtaataaaaactacttctgttacctgtgtgttcttgcaaaagataataaaataataagagtgtgaaaaaccctacctctgttatttcacgtgttttcttatgctgtctcctctgtctcccctgatcggcacacttgacccaactctcctcctggtcagggctctcctggagagtggctatcttggtaggaataaactggacagaggtcatctaagagccaacagggcgtctactggaataaacatgtttcctgtgagggggaccctggtcacagtttggacacataggcagggggcatccttctggatgaggcagcatcctgagaaaggcacattgtccacaaccaggcctgcttcccctggtcccatcggggcagggcgagggttgccactctcttcggagaaatctcaagacaaaactggaggtaaatactagggccttggataaaattagtttagccaattttaaagatattggcattttctttttcttttcttttttaaagatggggtctcggccaggcacggtggctcacacctgtaatcccagcactctgggaggtcgacacaggtggctcacctgagatcaggagttcaagaccagcttggccaacatggtgaaacccaatctctactaaaaatacaaaaattagccaggcatggtggcgcatgcctatgatcccagctactcaggaggctgaggcaggagaattgcttgaacccaggaggtggaggtttcggtgagccaagatcgtgccattgcactccagcctgggcgacaagagtaaaactctgtctcaaaaaaaaaaaaagacgaaaaaaaaaagacaggggtctcgccatgttgcccagggttgtctagaacttctcagctcaaatgatccacccaccttggcttcccaaagtgctgggattagaagtgcgagcccccgtgcctggccgatattggcattttcttattgtgaggtgagcagagaaaaatctgtgttgccaccatttattgttacattttttttttgtacaaagaagtatttaaagttgctagaaaagtaataaaaaataataaaaattgtctacatggtataaatccccttgggcattaaattcttgtagatattactggtatgctgagtaccctcaatgtgtgaagtaaaaacataaaaagtgttttatccaaacctgtctctcaaataagagaaattagatcacatttcccactggggagaagcatcctgaatgccaccctggctgtactccataccttagcctccagggtcagatatcagaacacgcattccagtatgtaaagttcacaccctgttttttggttttgattttttatttttaaacttcaaagcaatttttctttcctcctccagggcagaccagaacagtgggtgattttcctcctgccattttcttgggacagtgaaaagtggagaagagaatgtttaaattgttgcctgctggggacacatcgcactcctcaatttgggtggtgccaaccgctgttggaattagttatctgtgagtacagtaaggttgtatgttgttccgatgtcccatggtaaggaattattctctgtaattctcttgggctttgcagcccttgaacagctttgttcttctcttctggggtcatcatgccgagttctctggtgtataaggtggtccagggaagtctgtagctgcagtgtctactttttagaggccaaaaccttaagccatcagacactgggggatcttccatgtctcctaagggggctggctggcatttctttaccacattgtctctctttacgtttcttttccactgctacagtacccaggaaaacttctccaagtctatggtaagcagacatccacccagagtcaaaatgctggtctcctcttctagcgtaggcctccagtcttcacaagggactccctgaggtcctcctccctggccaaagggagggaaggtccccttcagggaagagtaagaacagcttcttcagccacctctgctccctgggtctggtctctttttctgttgctgaggatagcaggaggggattctgggagagggtagttggtgatgggacccattctcttaccatttcagtgagaaaagtgagacagggctggcctaggcaacgatctgaacttagaatgtgagaccttaacagcaattccagagcgatggcaacacacattcttattaaacgagttagctttatagtgatggcttgtttcatatctgggttgctagagcctccaggtaacacaatagaaggaatgtgcttagacggcccagagcatcagtccacactttcagttagaaagcaatgaatgtatgtgaaccaggttgttacatcaactcctgtctagggcaaggtggtgcgtaaatgagcccttgtatatcaacattttattttcattctgtactcttacattgatggaaaagtgaaaagttattatgattaatagtagctggattcttccctgtcagtgctaagtgatgatatagaaaccaaggtgcaaataaacgcaaatactcctacagataagtatgatcatgttcctgaccttttaacgttgtttatgccgtatgcacattctaaaattatcatttcctcttttatttgcagagctgaaattttgtctttcaaaggactagtgcatcactctgctgcaaagcttggaaaagctctgatagcctcaagtctctgctctgcttttgtggtggagccttggacagacgtggaattaaggttgttggaatcagaattgctattcctccactgcatagggacaggttacaaagttttagttgtcaaaaataatttgtccaatgagaaagtactttcctctatcctaacctcttaattcattgtctatctctgccagatatgtgtgtgagttaacccagatggaaaatgaaactttgtgaataagtgattcatttttaaaaaccacttttcttaacatatgtaaaaccaaattgtttgaaagtaacttttgcttattggaaagtctagtatcttaaaatctcaggcttcttaaaaaaatgaacctttcattttaaagtagatttacagaaaatctccagaaaagaaaagtgaagacagtacagaaagctctcatatactccacatccagtttcccctgttattaacatcttacatgagtatggtgcatttgttacacttaattaaccaatattgagacattcttcctagctgaagtgcatgtgttcatcattcagatttctctagtttttggctaatgatgcttttctcttccaggatcccgtccaggatcccacattccatgtagtcactgcctccttaggctcctcctggctgtgacagtttctcagatttcccttgtttctaatgattgtggcagttttgaagagcaccggtcaggtattttgtagaatgtcccttgtttgggattttgcaaatgttttcttttggttagactggggttatgtgttttggggaggaagatcacagaggggaagtgacacttttatcaaatcataccaagggtgcatatcaacatgacttgttagtgtcaatgctgaccttgatccattggctgatgtagtatgggtcaggcttttccacagtaaagttgctgtctttattccccttttcattgttgtattctttggaagtcactatgtacagccaacctttaaagggtggggagttggctgggcaaggtggctcatgcctgtagtcttagcattttgggaggccaaagcagatggatcgcttgagcccatggaggttgaggttgcagtgagccaagattgtgccattgtactccagcctgggtaacagagtgagaccctgtctcaacaaaaattaaaaaataaaaataaagagtggagagctctagttcaccttactgagggcagagtatctacataaattatacagactcttctgcacaggaggttttctagtcttctccacttttaaattcattcagtcatttatttatatgattcatgcatatttcttttttattttgggttaccatccaatgccaccttgtttgggttttttaaattgttccagctttggccattgatgagcacagttggatcttgtgtcattttgacaaactcccactgctttttgtgtgtgtgtgtgtgtgtgtgtgtgtgtgtgtgagaagcactttctggcattacaaggtaatcctgccttttttttttttggataatccttttttatcttttttaaaaaaagttctgtcctattgatataatttggatgtttgttgcctccaaatctcatgctgaaatgtgattgccaatgttgaaatggggcgtggtgggaggtgactggaacatgggggtggatccctcatgaatggcttagtgccaccttcttggtgatgagtgagcttacattagatctggttgtttaaaagagcctggcacctccctgcattactcttaccatgtgacatgctggctccctgtcaacttctgccatgattgtaagcctcactggaagcagctatcagcaccatgcttcctataaagctgaagaacagtgagccaattcaacctctttgtatactatgcagcctcaggtatgtctttatagcaatgcaagaatgacctaatacacctgtcttgagtatttcctgcctcagccctagaatcagccatttctccaacaagctctggttccttttattggtgaacagtgtgagtccaaaagtatctgagacacgtctcaatcaatttagaaagtttattttgccaaagttaaggatgcaccagtgacacagcctcaggaggtcctgataacatatgccccaagtggtcagggtacagcttgcttttatacattttagggagacaggaatttcaagaagccaaagaggagtcttgctgtgttgcccaggctggtcctgaactcctggcctcaacccattctcctacctcagctcctgagtagctgggatcacagtaggaactgcctatcaagccccgctgaatactgagtctttccatccctttctgtctgtgttccacacaaatgttctacttaactcttcagcagacctgacggatgctaacttattacctctctaggcttaactcattttatgagtctcacccatttcagcttttgtcttttccatagcataaacgaatattttccaaaatacagcattacgtaggtatgttaaacattacacacacattacataggcaaagaaactgtagttagaagtcacaagtgcaacaaagtttctccttttagggaatgggagctcaagtgatattaaatagatagattggttgggaagtggaaaatattgaaaatgtcagatgtgcttccaaatgagggtatggtatttgatccaaaggctacatactggttaatttactctgaagagctgaagtttattcagaatactctgtttttctttccaaaaaaaaagtgcaaaagacttcacaaggctggaggagaaggagctaagaggtggcctgttgcgaaagggtctgcaatattttacccctccttttttttgaagagaagcaatctcacaaaggtgcaactatcttcatcctaaagatattcctgtcaagtgttacaacctcatttagcaacttcttgacacttgtgaggtaaaagattccaaatctctgtatggtcaaagttatgtggagccctatgaagactggtgagttctgcccttgcttggtagaagtggggcagtcagagctgctttttgggaggacatcatcttagcactaggtcctgaaagagtcagtagaatttcgacaaactgagaagacagagaacggtgtgctaaaaaagccagcagcccaagcatagcaaggaaagtgcacagcgtgttcggagaaaatgattcgtctgctgcatgaaacggaatggaaggaatggagtccagtactctgtgcagttagaagcccagcctgcaagatgggctcagacagaagcagagggtcataggtagctttccaggagttaccatcagactttataacagcactaagcgggtgctgttatacagctttgtggagcacatgaatattatcctctaaggtgtgttgctagcacctttggggaagagaaactatagctggatatgggtagtgaaagttatgaacccagaacaaaaggtgttcagatttgctgattggcagggaagttctgggagcttcacatattctacagtcttgtatttcttcacaataatcccatatctttttttttttttttttttgagactgagtctcgctctgtctcccaggctggagtgtggtggcaagatctcagcccgctgcaaactccgcctcccggtttcaagcagttctctaccacagcctcccttgtagctgggattacaggcacacccagataatttttgtatttttagtagagatggggtttcaccattttggccaggctggtcttgaactcctgacctcgtgatccacccgcttcagcctcccaaagtactgggattagaggcgtgagccaccgcacctggcctcccatatctcatgtatacaacatttttctttccattttacaggtgatgaaactgagacccagagaggaaagctcattggcccaaggtcacatagcaaataggtggcggaggctggattctatgtgcacacccttgactggatgctttcaacctcatttttttttcttttttcaaagtgagcttcaaactttcacattttgaaaactgatggtgccctaaattacaatatagtgcctgtagcttactagctaccacataaatgaatgttgaataagtcaatgactgaataaatagatggctgaatggaagaggctcccattgaaaaagaacatccttttggctctgaaagtctggaaacacacagaagaaaaaaaggagagagagagaagctctgtgttttcatattcctggaaggctacagaaaaagaagtgaatacaaatttgtaaaaatctgtataaaatctagccaagtgctgtaatctcagctacttgggggctgaggtgggaggatcgtttgagcccaggagtttgaggctgcaatgagctgctattataccactgcactccagcctgggtgacaaaatgagacttcatctcttaaaaaaaaaaaaagtataaaatccagtgaaagattaccaaggccgggcgtggtggctcacacctgtaatcccagcactttgggaggctgagatgggtggatcacctgaggttgggagttcgagaccagcctgaccaacatgaagaaaccccgtctctactaaaaatacaaaattagctggacgtggtggcacatgcctgtaatcccagctactagggatgctgaggcgggagaatcgcttgaacccgggaggcggaggttgtggtgagccgagatggtgccattgcactctagcctgggcaacaagagtgaaactctgtctcaaaataaagaaaaaaaaaaaagaaaagaaagattaccaacataaacttgccaatgttaattttaattttaattttaatttttttttgagacagagtctcactctgttgcccaggctggagtacagtgttgtgatcatagcttactgctgcctcaaactcctgggctcaagcaatcctcccacctcatcctttcaagtacctggaactatagggatgagccaccaggcctggctaatttttatttttttacagagacaggggcttactgtgttgcccaggcttgtctagaactcctggacttaagtgatcctcccaccttcggcctcccaaaccctaaaattataggtgtgagccattgtgactggccatattatttttcttttccttttttttgttttagttacaaaagggatgtaaatgtgtgtgatcagagcccagagcaaccttcaaaagcctttgaccattacttttgatttttggtttccagtgtaggactttccctagaaatctgtttctagtaacctacacagtttgaagttgtgaatttctttttctgtcctgcagagtcttgcgcctttgggtacatgatgatgaggaagagctagctgcaagaccattcctcagcagtagtattcagttcctattcataacagaatgacattgaaagtacagtgactgcatttgtttattttttaaaatttcccagctcctacaactgacagttgctatattaattgcacaaaagtttgcacaaagactgagaagatgactgaattgaaattaatcccacactgtcaattcagtagtcatgtgaactcacatctcagaaacagtgggaagatagtagaaagaatgtctttatagtcattgcctttctcatagcccttttcaatatttggcaaattttttaatattaattactatttttttcttgtttcagtaaacctacacacatattaaatttaacatgaaattacattaatcatgtgttctaaaattttctgcatcttaggatggttggccatcttaaacatcttgctggcctccagagagactgcccctcccagggctggccaattctggagacaacaaagaacttagccaggagcatgtgttttatgtgcaaactacccaatcccaagtctactcccagccacaaccctttatttaactcttacacaccactccaatatcccccctgccctaaatcctcccagggccacctaccagatgactagagatgacccctgtagaccagagctattgggagagggaaagagacagagagggagagagatagagtgtgtgtagtactatgaagctgagcttacccatattttaaaatttgtgagaatttagctatattttcaaagaaagaaaatgtgcaaaacaatgtaaataaatttaacctgtaaaattagtatttttgaataacccagtaaagaaaaggaaagattattaaaacatatttgcacagacctttaatgctttccaagccactgtttaaaagtcaaaagaggccaggcatggtggctcatgcctataatcccaggtgggtggatcacttggcatcaggagttcgagaccagccgggccaatatggtgaaactgcatctctactgaaaatacaaaaattagccgggcgtggtggcacacacctgtgatcctagctactcgggaggctgaggcaggagaactgcttgaacccgggaggcagaggttgcagtgagctaagattgggccactgcactccagcctgggtgacagagcaagactccatttcaaaaaaaaaaaaaaagtcaaaagaaactaaatgttattagtaaaggtcaaacctggaatagaaagtatagagaaagaaaagttggtgtgtgtgtatgtgtgtgtatgtgtatgtgttattttataaaggcttatcttcaaagaaactcaaatgaataactatgtaactctctctgtatgtaactgtaactttcacttgcaaaagtgtatcagtttgaacagttaaatcacacattcacctatctaagcatcacatgataagtaatgtttagataggtgaatgcataattttagtacagggaatttttagaatctttttagcacataattagataagcatgtatggaaagtatgttgttacaaagagtttactctgaaggacccatagtaagtcctctaaaccagtgcttaatctaattagttcttgtagctaatgacaaattacatagttttataaattaccagtggtcactaaaaattattactatcaccaagtctgttttcttgatttttcttataggttgattttagtgcatttgagctacaatcatattttattatctggaaaatgcctcgaagacatctgtggatctacaaacttccagggctactctctgcatacaaaggaggcatgaacaggcctttctactcagaagtggactaaggtgaatccatcagctgacatccgtcatagttctttgtgtaccaaacacctcatgtatgttgaaattagctgatttcatgattcaaaatagaccccatcttcagcctcaaggttgtccagtgcatccccagttcaacctcagaagaaccttttcagaagccaccagctcatgacacattccttctgggggtctctggtgggcacagaataagccccccttcccctcagggtctgcctgtctgccccttaacctgttctcctgctcctccattccaggttccctccacctaaggcaaactgcccggggcaactgcccagcatggaaagctttggtcttcacggtcttgactttttaccagcatctctgaagccccaaagtcacataagaatttatttgactgaaaattatttaagaactttatgtgttaattttccttataaagtgaaagttgatcactttcttttcccatatgtcctttgcccagacacaacttattgttactctgttttcaatatcgaagcaagaaatggaattcattgtgagcctgccccagtgctattcagactcattctatccagggagcaacttcactccataatttgtgtagatacagttacttacctacccactctctagtacataactccccatacacacccacggacttcttcccctagggaactagtcagtggtgtgtctccctttaccaggcaagtgcatgaaatcagtgcatgatgtgctggtcaatgtggtgatcttttcccctcttttaacctggggaagagagtttatggcagaaaccacagctttaatccacacatctttgtgtaccaacctcagtgttctacaaggcagagaagagaatgggtccagcgattcctcctgagcagttgtcacggaaatctcttgctctcctttgggaagatgagttttactctcaatgatgcattgatactcaccattattacaaggactagtgaacaagaacttgttatgtgccagcactgtgctatgcttcactcaagccagttaattcctgcactctcctgcattactgaatgatttttcttttcttctgaatggtagtttttaaatgtaggactactgtttcttcatcatttgagtttgggaattaggcctcaaatgaggcagcttatgaaatctgctttggaggtcaggggtcttctccatagtggaaaacatctacctgaccctttttaggccccaaactcctctccagggtgtagtgaatgcatggcactggcatccctcctgtaaatggaggggcttagatctctggaggaaacttctgggctagtatgtggctaccacgagaatggctacaagtgggaataaaagggctttgatcaccttagtcttgagttccaggcagtttttctgggccatgtcactgatcaagcatggtgacatcaaagtaaggtattttcctttttttttttttgaaatagtgtctcactctgtcgcccaggctggagtgcagtggtgcaatcatggatcactgcagcgtccgcctcctgggctcaagagatcctcccacctcagcctccagaggagctgggactgcaggtgcacaccattacacctggctaatttttgtattttttacagagatggggtttcaccatgttacccaggctggtctcaaactcctggcctcaagtgatccactcgccttggcctctgaaagtgctaggattacaggggtgagccactaagcccagcctggtatcttcttttgtacttttcagaagaactcaaaatggatgagtttgcataaaactgcatctgctgctctagtgccagtgaataggccatgaagcttctggctcagatgggactttagatctatgacctgctgggtattcagaaagcagccacagatagcataggagttcaagacaacaatggtgcgtgaaccaccatgggtcaagaggagccgttgatctgatctgatctccgctgtccccccatggctttcgtgcagacatagctggcagcctgatggcggtgctgtggaagcaggcccttcactggggtactggcagactggttgaagagtctacctacaggggagtgtcgagtccggctctccctatgggcaacaggcaagccacacagaggaccaactcttgaacaaacgttggtaacatttgtggtactgagggttgaaagctagggggattcttaaaactattaggagattctctcttgctagtgaaacagatgggaagcagaggaactactgcactttggacattgacttcagttttaatcacagactgttaaggctaggacatatttttctttaacttttagactcggggtgcatgcgcaggtttgttatataggaaaacttgtgtcacggggttttgttgtacagattatttcatcacccaggtactaagcctagtgctcaatagttattttttctgctcctctccctcttcccaccctcccacctcaagaaggccccagtgtctgttgtttgcctctttgtgtccatgtgttctcattatttagctcagacttataagtgagaacatggggtattaattttctgttcctgtgttagtttgctgaggataatggcctccagctccatccgtcttctggcaaaagacaagatcttgttcttttttatggctgcatagtactccatggtgtatatgcaccctattttctttattcaatgtttcattgatgggcatttaggttgattccatgtctttcctattgtgaagagtactgccatgaacattcatgtgcatgtgtctttatggtagaatgatttatattcctctaggtatatgcccagtaatgggattgctgggttgaatggcacttctcttttagctttttgaggaattgccacactgctttccacaatgcaatggttgaactaatttacactcccaccaacagtgtataaatgttcccttttctctgcaaccttgccagcatctgttgttttttgacttttttatagtagtcattctgactcatgtgaaatggtatctcattgcggttttgatatgcatttctctaatgatcagtgatgttgagctttctttcatatgtttgttggctgcatgaatgtcttcttttgagaagtgttttgttcatgtcctttacccactttttaatggggttgtttttttcttgtaaatttaagttccttgtcgactctggatgttagacctttgtcagatggatagcttgcaaaatttttctcccattctgtagattgtctgttcactctgatgatagtttgttttgctgcgcagaagctctttagtttaattagattctatttgtcaatttttgcttttgttgcaattgcttttggtgttttcgtcatgaaatctttgcctgtgcttacgtcctgaatagtattgcctagattttaagaaatatttaactcaaagcaacaatattaacagttcatttctcatctgaaacaatagaagaaaaaagacaatagatcaacctatgtttttgagatggagtcttgctctgtcgcccaggatggagttgcaatgacacgatctcagctcactgcaacctctgcctcctgggttcaagcgattctcctgcctcagcctcccgagtagttgggattacaggtgcatatcaccatgcccagctaatttttgtatttttgtagagatggggtttcaccatgttggccaggttagtctcgaactcctggcctcaagtgatccacccacctgggcctcccaaagtgctgggattagaggtgtgagccacctctaatcccagccacagactgaactctgagctttttttcttttttctttttttttttttttgagagggagtcttgctctgatgcccaggatggagtgcggtggtgccatcttagctcactgcaaactccacctcccaggttcaagcaattctcctgtctcagcctcctgaatagctgggattacaagagtctgccaccatgcccagctaatttttgtatttttagtagagatggggtttcactatgttggtcaggctggtcttgaactcctgaccttaagcaatccactggcctcggcctcccaaagtgctgggattacaggcatgtgccagcacacccggccagcttttttcatatgcttgttggccatgtgtatgtcttctttagaaaagtgtctgttcatgttctttacacactttttaatgtggtcgtttttttctttttaaagaccctggatattaggcctttgtcagatgcatagttgcaaatattttctcctattctttatgttgtctgtttattctgttgataattcttttgccgtacagagcctcttaagtttaattagatcccattggacattttggttagcaagaaaggacaatgcctagagcaataatcacaatgtaggacgtctttaaggaacaaaggtaaaagtttctggagattgaatgaccaattccactaaactgtcgcagcttgaaaattaccagaatgctctgtccatcaagtttagagaaatgcttcaagtttaggggaatgatttctattgtctatgaatacagctgaaaaaaaacaaaccccgtcaaaatatctctctcttttgggatggcagtgttcacaagcccctgttgcccagctacacaaaatagccagacatcatgcacctggtcccacaatgttgagatatgtagtgatttatgatcataataaattagtgtttcccaaaacttactctgtggaaccttgagtcaaataactttgggaactttgccaactgtatcttcttaattattgtgaaagttgtcagaatcaaaatggagtcatgaatgttaagaaaaccctgacaaatggagccaacaaaaaccataaagaaggggttctgacacttgtgtgctcgataatgaaaaagactatacaaaaaccacaacctggcacacaacccattgcaactgtacaaaaaatatatacaagaatatctgcccagcaactgcctgtccaaacttgtactggtgtcacccttgtcattgatctttgtaaccaaagataagtatttcaaaaacaattatgtagtcctcatttttttctttagaaatctttgccttcttttacctccctgacacatatattaatagtttgctatggcatgtatatgcccattgcaatgttctattccctaataaacatcttcttctagagagcctctctctgttatttaggttgaaaatattcttaagacatgtgagcctatttcatagctctgagaagttagatgataatgtgcctttacgtcttgtttagtcaataatttgcccaaattatttggtcttgaaatgttactttagcaagatacctattaacagtttgtataaatctgtctgatatagtgtagtagttattctttttttaattcatcacatctcttaatgctgatatgagagaaactttaagcggtaattttggtgcaaagatactgagcataatgctctaagacactgagaacacacaagaagcagcgaagtttgggaattggtaatatgaattgttagaagatcaatagactgtggaattctaggttgccctctggaatgtagactaacccactgaccatctggtaggttaggaggcagatgaaaccaagagtgtcctcctgggcctatgaaaataaggaacaagcagggattaggaaagatgaaaatgaggttcagaaggagtgagaaagcaggaaaggccaagagataattgactataaacaaagaagaaaatgtcagagttaaagatggtggaggtggagaaggtctaagcagtagatggcttcatctatttctgggtggatgaagtggaggggagatgaagattcttggcagctgtgacagcgtgcaaggagggtcttgaagaattagcagcaaggagagtagcaagcacaggctgaggaggtgcctgggactcaaatgatagggattttaaggaataataatcatgacacaatttatgccacacccctcagccctcaccactgcagtgcaccctagaagcccagaaagagcctgtccagatgcagggcaggctgaaactgctggggagctaactcccccaaaacattccccagcagcagcctggcttccttacatctcaggtagggcagctgtgagatgtgtgtttttcgctttttttaaaaaagagttttcttgaaggagaaaaccccaggtgcccacatagaatgtatgtgctgccctttaagtcctgctttccattccaggaccacttcttcccttccccaggaggtgtttccagccccttccacagaagctacttgtgttgttggtgggccagttcgggttcttgacttcgtggcacaacataatttgagagtgtgatcggcgcagtggctcatgcctgtaattccagcactttgtggggccaaggcaggaagattgcttgagcctaggagttcaagaccagcctgagtgagatcccatctctataaaaataaatgaataaaataaaaaagaaataaataaaaaaaattgagagtgacttcaatgtgaaagtaggtaaagaagtttattgcaaagtgaaagtaactctgatagctgggtgcatgagaaggagacagcgccatgtgacactgaagtactacccgttatgggagatgcgcatgattattcaaaggggtgagaagtggtgttgctgttgagcgtgttgcagatggtttcccaagtctgcatgtgcagtggccatacaggctactacatatattggatgtctcattagcattttaattctccacccaagggtgtgttttttactattataatgaacacaggtcagctcaaggacactaatgttgggtttctgtgttcatgcgaatttgtgaattttcccgtctgcccttctacctcctcactgcaggatgttctaaccatgagcccaggatgtggtttgtgcactgttaggcagtttgttctctccatcaatttggtaagtttgttcccacttaggcgaggctatgagcaacctatttaacctacctcacttgggtttgaattcttgtctcaatctgcatgtggggaacccaaactaattcacaaacatcatgtcatttggccatcaagacaactctaaaggatggcagaataatattatttccccttttattttattttattttattttattttattttatttattttattattattatttttgagatggcatctcactctgttgcccaggctggagtgcagtgatgccatctcggctcactgcaacctccacctcccaggttcaagtgattcgtgcctcagcctcccaagtagctgggactataggcgtgcgccaccacacccagctaatttttgtatttttagtagagatggggtcttaccatgttagccaggctcgtcttgaactcctgacctcaagtgatctgcctgcctcagcctaccaaagtgataggattacaggcgtgagccacagcactcggtctatttccccttttaaaaaggaaacaggttgtacctttttcaaagccacccacgtagaaagaagatgagccgagagatgaactagccttctgacttcatgctctgtgttctcatccctacatcctgaatccctatattcaagatgtgttactgtccacaaggttggtagattaccatgaggatggagagagggaagtatatattgatgtatgaatatcaataggtaaattatgagaatgtgatagggaaacaatgcccaagatgaaacatgggcattatgagtacaagggaagaaggtacagtgcaatggattaacctaaatcaaaggtggtccaggactattgaaaaccatgtgttaaccaaggtgataagtcaaaagggcaaaagaccaaagatagagataagtttattcattgtagaaagtggatttagggcagggcgcggtggctcacgcctataatctcagcgctttgggagaccgaggtgggcggataacctgaggtcgggagtttgtgaccagcctggccaacatggagaaaccctgtctctactaaaaatacaaaattagccgggcatggtggcgcatgcctgtaatcccagctactgcgaaggctgaggctggagagttgcttgaacccgggaggtggaggttgcagtgagctgagatggagccattgcgctccagcctgggcaacaagagtgaaactctgtctcaaaaaaaaaaaaaagaaagtggatttggtaggaaccaaaggatgtccgaaaatatctttttttattggtacataataactgtacacatatatggagtacatgtgatattttgatacatgcatacaatgtgtaatgaccaaatcaggacatttagaatatccatcatctcaaacatttatcttttctacatgttgggagcatttcaaatcctgtcttctaactattttgaaatatacaatatcttgttgttaactctagtcaccctgctctgctatggaaacttacttattccttctctctaactgtatgtttgcacacattcaccgaccctatactgcccactgtttccttctcaggcttggaatcttttgagatgtgctcatggtcattaataagacatttcaatattataggattacagaaaatagcattacaggccgggcatgatggctcacgcctgtaatcccagcactttgagaggccaagtcaggcggatcacctgagatcaggagtttgaggccagcctggccaacatggcgaaaccctgtctctagtaaaaatacaaaaattagctgaatgtagtggcaggcacctataatcccaactacttggaaggctgaggcagaagaattgtttgaacttgggaggcggaggttgcagtgagccgagattgtgccacttcattccagcctgagggaaagagtgaaactccatctcaaaaaaaaaagaaagaaagaaagaaagaaaatagcattacaaaactgaagagattacaatactggtctcaccatcatttttattactctactccctcctttcctagctgacactcgctccccatccatgtctattcatctaaaaatcctgatgtcccctggctgttggcctccaggctgctggatttggtcccttctatgacaactttactgacagacaccagccttctaactacacagaagtcctgctgcacttcataagatgatggagtgaatgtattcctgtagaacattatttgcacaggtaaccatggaaataatatttattttgtctaaattagtcacatgagggcaaaccgtttccttatctgcactctctttttctttttaaaatgagttcaaggcaatttagatgagtggggactaatgggaaggacctttgtgaaatcagaaagcttggatttctctcttcattttacctctgactgatcgtgacaccataagtaagacatataatagtttcattagaagaccctgttgagaaaggcaagagcagggagccatttagtgtgtgaggtacctgctggttgaaaaagttatggggctaaaaataatctcaacatgatgactctgttgaaattaggcacccaggcaaataagctggccattgaccaacccaggagactgccattttcccactgcctatgcaaagatcagacaggataaatagtcctggaaaaaccacagtcctggtgagggggtgagtgtggggggttgacaagtatatggtttcaaaatgaccataaagatggaagcatgatctataattctcatgatgcctcttaatgagtttgaatagagagcacataggtgaaaaaataaactatgcaaatataaagaggggtgactggttggaaacatgattggcaatgccaaatatggccaaagatttgaaagatgtagacaatcccaggtgaatgcttataatgttattcatatagtgctatattaattctaaatgtataggaagtataattattcattttcttcatatttttatcataggaagcttctagcagagaagttgaaagaattttacagtatatacctatatatgcacaacctagattttacaattaatattttactatagttactttattgcatggctatcagtctgtccatccctttctcatccatcaactcatcttggctttttattcatttcaaagtaaattgcagacatcagtacacttccccttataatcgatagtgtttcagttctttatttattttattttttgagatggagtcttacttgttgcccaggctggagtgcagtggcgtgatctcagctcactgtagcctccaccttctgggttcaagatcctcctgcctcagcctcctgaatagctgggattacaagcgcacgccactgtgcctggctaatttttgtattttttgtctcaaaaataataataataaggagtcagagacaattttaataaggattattaaatggaaaagtaatttattaccagatatttagagtcttcttccctccccttgtgtgcagtctcactgcatagcttattatctagaatatagtatgtgtactattaaatatctgttcaactgaatgtcagtaatctttggggtcttaacctgtttgggcagaaagacattagctggatgaccattccagattcttgactagcttggcattctgattttaacatttaactcaatttcacagtcatttgatcttttaaaaagtttagaatgttttcatgagcctgcctgcctggagggccctcttccccccagtgcagttcacaaaacatctgcgccaaagtgcttcgtgcatatggaattgactactactgcttcggggctgggacagggttgaatgcgatagccatcattttaacaaactgctacacaaaacagcactacaaagggagtattgattggatcctctatctgcctcccccagcactgctcaaagttgaatgtttccattgactttctaattgttccttcccccccaactttattctaaaggctaaactttagaataatactttaatactaaggaaaatttagtatagtctggacctgtcatgcatcctgttcaagggaaggaggggaagtaaatgggtggcaagtggaagaaggacaatctaattggacacttactagatgccagggattttcttttcttttcttttcttttttttttttttttttttttgtgacacagtctggctctgacgcccaggctggagttcagtggtgcaatctcggctcactacaacctccacctcctgggttcaagtgattctcctgcctcaacctcctgagtagctgggattacaggcatctaccacaaaccatacctggctaatttttgtatttttagtagagacaacgtttcaccatgttggccatgccggtcttgaactcctgacctcaagtgatttgcccgccacagcctcccaaagtgctgggattacaggtgtgaaccaccacacctggcctgggattttcatatattctgtattttatatactaaatatttatttaacactcattatgtgcagaaattttcatatactatatatagcatttgtctcattcgatctccagaggaacattgtcatcctaaaacccattttccacgcaaagtagaaactgatgttcaaataaatgaatttgaatttaaatctgagcttggttgacttcaaaaatccaagcagtctccattccctcaccctacctaaaggagttctgctaacaaaaggacctcgttttgtcaccgggggtcctggataccccaaaaagggctctttcctgttcagtgttgtgaagataatacaaaaagccgaaagtgtcaagcagtgcaggctttattctaaggccaaggaattggagaagtgggaccgtagcttgcaaatcaatttctcagtttctgagaaccaggaaattacaaattcagggtatcttcactgaaggggttgggcattaagagcaaggggaggaacattcatggtttttttgggaagcaatgaagattttcctagaacagggagctgccttttttgtcctttcttggtcttttctggttattgtcatagtgattgtcagctgtcatggtgctggtgggagtgtcacttagcatagaaattggattataatgaagctagaggttcttcagaggtcaagtaggcggccatactgggtttcaccagtttcagccagtttagttctaagaaggaactaatgaccacaggcatcctgcttcctaaaaataagcagagttaaagcccagtaggaatttagctatgtcatgtaggcattacattgggcaacaaaagcagagagggggcccagctaagccacctaggcactacaatgggtgacaattttatagtattatagaaaagattctctgtctgatttcttccacgtttacagaactccagatttactttcaggagtcaaagcaccggggaaagattcaacttccttcagagattttggaaacagagttaagggatcatttctcctgcctctcactcctacatcttctttcttagctgcctcctaactccattgggtataggagatctgggttagtgacaaaggatgaaaaatgaaaaaaggatgccaaacaatagcaattttcagggtagcaagaatgccattttggtaggcagcttctatgtctcctgtgcaatgattgctgctggccaggatcacccagccaggagggtaaattggcagtgtgtttctgcctcctgcccagaaggtgcccattgtcttcatgctggtccttggcaccctggaacatcccccatccctgcactgcagtgtcccaattcggcttactcagtgtggctggcacccatcatcccaaattatttctctctgctcagctacagaattatcatttctatttccaactagcaacagcttgtcacccatcagagatatatttccatctaaacaaagctcttatcctgccagtcctttgcataaaaatgttcagtgttttcctgttgtagttagaatgaacccaaactccttgccatggcctgtgaaacccgtgatctggcccagctctcctatttcatgtcctattactctactccttgctcgtgggacccagacaccattcttgcttttctaagacactccaaatgcatttttattctcatttgctgtaacctacttctttcccatcatgcagggtgcttgctcattcggaatctcagaggggtctctgttaacccttcaaccttgaatagcttcctccccacccacagaggcctctcttttatcatcaccttttctattttttcaaagagagtttcacagttagaaatcatgctttagatggatttgttcattttgttttctgactccactgaaatatctgctccatttgcaaggggccatctctacctgtttttcactatactccttgtgtgtagaacattgtgtactcaataaatgttgttcaaatgaaggcaatttatgagcactaagggttggctgaccatcatagcagaattctacctaccatggcaagcaggtaaaggaaaggttttgcatggaaatgggaggaaggaggtagggattaggtcctacactctccctaagattttcccacattattggcacacataagtcaaaaacaaatacaggcagtccttgttgtgcttggtttcagtaggcgtgaatatcagttaccatagttaagcttaataagccaggcttctaacaacacagttaaaatttcaattgttaccatgatacattaatttgtgagtaattttataaagtactgacatcactgccaggaatcagttcacagatcattaaatgaataacgtgctcatcctggtcagtgaccgatcacatcactcctcacctctctgccataagtgaaacccccctgtggaactatggtccctatagctctctcaggaacatcattcactgtggttcagcaggactgctgacattctcccagagtggactccaggccaagctttcatgaactttcctctattttttcagctgtgaagtagagagatgtagagatgtagaggttgaagacaggtgggctctgatgtgtgtgggcaaagcccttttcctttctgtaaccctaccctgagtgcaggtttatcaggatgttcagggtgctgacctgcttccaactcggacatgagtgatttgcgtcccagagcatcatgttgcaggcactgtgcctaatgctttgtattatttcatttaaccttacaacagttttatgcagtactgttataggactgacaggttcatatgcctgctgcacatgagcagatcaatacattgagacagcaggctttgcagcagagaacaagtttaatgactgcagggtactgagagaggagatgagaagagaccccgaaatccatcagaagttctgggctggggtttttaaggaaatcatggagggagagggactggagaattggagttgttgattggctgggggagggaaatgaaatcatcaggatgtggaaactgcattcgtgggcgagtcagcttcttgggtgcttctgaccatctgagtcaggagttgcattggtatgcagtacctgaaggaaaatctcaaagggaaaacttaacatttcataatgttcaagttgttacctatagagcagttaaaggcagctatgatcttgtgacagggtctgtgtgattctagggcaatgggcaccaaacagctatgaggaagggttcagagagcagctgacctcatgctgaatgctgatgtgctgcaagcttggcttattttcatttttcctttctttgctgattaattttataaagttcataaggatggcttcagtacaaactactgatatccccatttaaagatgaagaaaccaaggcttagaaaagttaaataatttaccagagactcatgctcttcttttgaagtaacaaatacaaatatttatgttttcacaaaaaattgtggaagactatttttataatgataacatgccctttgaaacgtgctacttttaaatctgagtcatcttactccctaaaaaccaacaagaaaagtggaaagcattgccatatatatatatatatataattttttttttttgagatggattctcactctgtcaccaggctggattgcagtggtgtgaccttggctcactgcaacctccgcctcctgggttcaagcgattctcttgcctcagcctcccaagtagctgggattacaggcacacgccaccactcctggctaatttttgtatttctagtaaagatggggtttcaccatgttggccaggttggtctcgaattcctgacctcatgatccacctgcctcggcctcccaaagtgctgggattagaggtgtgagccaccgcacccggccgcattgcccaatattttccagaggttttgtagatatggcatgaagccctctggcaatagttaaatgacatctttcgacaattctgtggccacaataggctgaacaccaaaactgatgctagatagattatgacaaagatgacttttttgtcaaaagctctttcctctcttttctgccatcacagtacagttggatgttgtctgattgttgtagtggtgttagtcatctgtttgtttgttttttttttttttttgagacagggtctcactctgttatctggctggagtgcagtggtgcagtcagagctaactgcaaccttgacctcgcaggctcaagtgatcctcccacctcagcttcccgagtagctgggactacaagcatgcaccaccatgcctggctaatttttgtattttttgtagagataaagtcttgctatgttgcaaggttggtcttgaactcctgggctcaagtgatcttcccatctcaacctcccatagtgctgggattacaggtgcaagccaccgcacctggccctagatgttacgtttttaaactcatctttttagtttcaattttttcgttgttgttattgtgatttgtttgtttttgagacagggtcttgctctgtcacccaggctggagtgcagtagcacaatcagagctcagtgcaacctcgaccttctgggctcaggcaagccccccacctcagtgtcccgagtagctgggactacaggtacacatcaccacacctggttaatttttaattttttttatacagacagtgtctccttatgttgcccagactggtcttgaaatcttgtagccaagtgatcatcccgctttggtctcccaaagtgttgggatcacagacatgagccaccgtgcctggccaaatgttttcatatttacagaaaagttgcaaagatagtacagagactttccttagatccgtcaacagctttccctaaagttaacaacatcttataccacacattctttattcatcagtatctactgagcacttagactcagcccttactatacatgaggcataatcctcaaaatcacactgcaaactctccgttttatatctgttccttggctctcactggtcgttttacttcagtacctggtctgtcttttaaattaagtagactctagggtaagttcttctggccttggaatcagaaggcttgaatttaagtcttgactctgccgtttgccaattgcttgacccatgttttttctgtaatactcaccctgtcaatctgggagagctggtttgagaatctgtcacgtgtcaactctgaaggaggatggccgtgtcaacctcatttctccctgtctccccagtgtcttgtcaaaagccagaacttagtaagcattcaacaggcagtgggtgcactggctgagtgattaaacaaggtaatgtttaaacaaggtaaaaaaggtaatacattaatattggcatgcaaatgttaggagttttaactgctcatataaaaactcacacgatctgcatgtgttgctggtgtcccctgtttggtgcccatgaatcacttcctgttttgttcatgatggagtctgaaccccttataagtgagtgcctgggaagtggtagacgtgatgaactgccttttcatcctattaagctatgtttaaaaaatgctaggcaaagtggtagcttattacttttgctaataaatattttctgatagtttatgagaactcgaaagccaatgttgctcttatttccgacttttacttactaaagtgctgatatccatttttgttatatattgttttcttgatttcattttgtgcagaaagtaaatgtgtataaatcatgcatctgcattttgttatttatttctggaaggtgaaaatatcttcatctaactcttggctttcacctgtaatgagttttgtgtttcattttgatttgattttctttcagttctgctacatcaatagacaaaacttgaaatactatatttaggatccctttgctggaagagaaaactaaacatttcatttagcgcttcagccccaggaggctgtataccatgtcactatttccatgctttgacagttgggtgcagttgtctcttgttattagtaaatttcatgaatttgctggttctggggaggaagcaaaaggtgtaaatatttgagtattccctgcatgtagcaatcccacagtgtcacatctgtctaatacctttatgagacagtccatttgcgtagagaataagtgtcctaggaaataaagctatcaggagtgtcgaattggaatataagaatgatattctgagcttaaaaaacatatataagactggagttcattgatatataaccttgaagagtgctctgaatgacaatcatgttgttatgctggtagagaattacgaagttttagaactggaagttctattttttttaacctcattttatgcatgaagaaatggagaccagaagggccaagagcctgtgaaattcaggcagccagcgagagactgagatcatgcagagataacaagctctggggtctgccacccagctttctcttgcgaagggatgcttttcagccattgttgattattcagcttgggggttattcagggttaccgcttttctgccttagtcttgcttctgcctctattttagcaaatctactaactgtacctggtagggctgtacctgagaggaggtgaatcctcagctagccaattttgtgttttagaggggatttggtaaagattcagtgtgaaggactttttttttttttttaaagataaaaaacttttttttttttggctgggcgcggtggctcacacctgtaatccctgcactttgggaggcagaagcaggtagatcacctgaggttaggagttcgagaccagcctggccaacatgatgaaaccccatctctactagacatacaaaatgttagccaggtgtggtggcaggcacctgtcattccagctacttgggaggctgaggcacgacaattgcttgaacccgggaggtggatgttgccgtgagctgagattgcgccactgcactctagcctgggtgacaaagtgagactccatctcaaaaaaacaaacaaacaaacaaacaaaaaatttaaagataaaaaactttttacaggattctgttgttttagtctatgactccatggtttcctcttaaggtgattaaaaacattttaattcaatggggcacagtggctcacatctttgggaggccgaggtgggagaatcacttgagctcaagagtttgaaacaagcctgggccacatagtgagacctcatttgtattttacaaacaaacaaaaaattaaaataaataaaaataaaacacttttaatgtatttgaataacccccaagctgaataatcaacaatggctgaaaagcatcccttcgcaagagaaagctgggtggcagatcccagagcttgtatctcttctttattatatcaacatatgtactttttgtgtgtgtgtgtgtgtgatgaagtcttgctctgtcgccaggctggagtgcagtggcgtgatctcggctcactgcaacctctgactccctggttcaagtaattctcctgcctcagcctcccaagtagctaggattacaggcacgtgccaccatgcccagctaatttttgtatttttttttttttttgagacggagtcttgcactgttgcccaggctggagtgcagtggtgcgatcttggctcactgcaagccccacctcccgggttcacgccattctcctgcctcagcctcccgagtagctgggactacaggcgcccaccaccacgcccggctaattttttgtacttttagtagagacggggtttcaccgtgttagccaggatgttctcaatctcctgccctcgtgatccgcccgccttggcctcccaaagtgctgggattacaggcgtgaaccactgagcccggcctaatttttgtatttttagtagagaaggggttttaccatgttggccaggatggtctcgatctccaggcctcgtgatctgcccgcttcagcctcccaaagtgctgggattataggcgtgagccagtgtgcctggctgacatacgaacatattaatatagaaatcttattctagaaaatactcttttaatgcgcttcgtcctatgaaataaagaaaaaataataataataataaagtactttgcagtctggtttggtagtctccctcatcccccaccccagtggccatccccatcccacgcagctggccaccactcctccttgaggccctttcttcacctggctttccaggacgtggtgccctccctcttctcacctctcctgctgttcttcatcgccccaaccttcgaccttgtctctctctacacccaggctcatggaataagacaccaaatacgtggtggtcactcccagatcttgattttcagctcagacctctcctttaacctctaaatcacatatgcaggtttctacgtaaaatctccaaaatagatccaaaccacactcttgaaattctccaaattcttccccatctagctattggcaacctgatctgccagttggctgagtcccaaattccacgttatccttgattcttttcttttactctcacgccccgaatttaataatcaggatgttgtcttgcctctaccttcaacatatccataatttgacgacttcttacccctgcactcctatgttctaaggagcgaagtactgtgttctaagccaccgtcatgtcttaggttatttcaacctctctgactgttggctctgttgccccacccctgcctccacagtctacacagcaacctcagcgacttttgacaactgacttctagtcatgtcgcttctcttctcaaacccagcaacatgccacctcctgttcctagtttccctctcctggccgccttggtgctccctgacctctggccatattttctctgggtgccatggcacagctcctgctctgcagccaggattgcttttccctggtgtgtcctcatgaagctctcactcagggcttctcagtgttcattcagagggcactttggcatctaaacccttctcagaccatcccggctgaagttgcagctcatatggcccgtggcactggctcttccttagttcatttcccccgccaagcatttagctttatctcatagcacactgtttattttatccattttatgtcatccatcttcatatttattacctgttcttctgctagaaagtaagcccctctggggcagggattcttgccttttttgttctctgtttcaggctccatctctagagcagttcctgccacccagcagacacaggattgtttgttaatggatgtgggaatggatgttgggccttataaacttgatgagaatcctgcttatgtaactcaaggaaggtaattgcacccttgggaccaagtttgttaatttgtaaaatagaaacaataagagtcctcacagtcttgtatgttgttttgagggacagattatattgctgtatataaaatgcatagtattaagttcttcacacactatagttgtatttttgtttttttttttaatttttttgagacggagtttcactcttgttgcccaggctggagtgcaatggcatgatctcggctcactgaaacctccacctcccgagttcaagcaattctcctgcctcagcctcccaagtagctgggattacaggtgcccaccaccatgctcagctaatttttttctatttttaatagagacagggtttcaccaagttggtcaggctggtctcaaacacctgacctcaagtgatctgcccgcttcggcctcccaaagtgttgggactacaggcatgagccaccacgcctggctatagttgtattttaaaaatttatttatttatttattttggagctagggtcttgctctgtcgcccaggctggagtgctgtggtgtgatcatagctcacagcagctttcacttcctgggctcaagcaatcctcctcttgaatcttctttcaagagcattttttatatttatgcagaaaaatattaatacattttttattccctggctgttaagagaattgactataattaaacgaccaagatcttataattatattatcttagtatttataattgatcttagtattgtaatatattagtataatataatattaagatctcagtagttataattgtagttgaaatacctcaagttatttttcctaaaagttctattcaaaaacattttaatacatttataagttttgtttttctagaaattgttagcacactttttggtgtcattattcatagttaagaagtgtactatttggtatctaaaaacgtcacggttgctttgggctaggtacattttcaatgtccttttatagccattataaaggtaatttttagagaattaattgctttttgatgtttaacattacgtggaaaaaagtaaacatcattaattctaggtatttttccctcgggtgccaagatttcatcatagctttaaataaatttaaattttaaattttaaattaaaataaactactaatttaaaataaattactaatttaaaataaatactaataaattttaaaaataaattactaataatttgctaaatggtatacatgtaatttaatattttaattggcagttagtaaaatattgacattaatgccactactcatattcattttagctcaaatttttaaagaatgactgcgaataataatacaggtgttttggggcatagtgttgtaatagtgcataggtccaaaatatattgctcaacttttcaaataatttgccttgttcatatttttgtatgattttggcttatactgcaaacactgtgtctcaagctaaaggcagatttcccctgaacctctcgttttcctgaactccaccaagagcatcatcacaactgctttccagggtgatctcctgggggcaatcatcctcaagaagattgatatttatcctccaaatatctgtcacatttattcctattaccttagattaatacaagttgtcatttcccataaaaactagtttgaagatgagtctctaggccgggcatggtggctcacgcctgtaatcctagcactttgggaggcttaggtgggcggatctcctgaggtcaggagttcgaaaccatcctggccaacatggtgtaaccctgtctctactaaaaatacaaaaaaattagctgggtggtgtgcacctgtaatcccagctactcaggaggcagagacaggagaatcacttgaacccaggaggcagaggttgcagtgagccaagatcgcaccactgcactccagcctgggcgacagagtgagactctgactcaaaaaaaaaaaaaaaaaaaagatgatgagcctctagctttgaccccttgtagttctacccaccatccagccagtgatctgtgtgtttcagactagtcagattctctgttgctggcctcctccaggctacctccttagcatagcgtgtaccatctgatgtccaatcctgctggatgtggagccaagggaaagggccttgtccagtgcggagaaatctccctgggccatccctagggggcaccatgcagtcagtaagaaagcaattattcacaaaggacaagtgacctggaaaaggtgtgtcaggtggagggtggggctgtacaaaccagacaggatgaatgaaaaagcaaagatggtactataaatcaggaggcaggaaggggggactcctaatgacatgcaggtcccttagcaatttcctttcttggaggaaatgttaaatttataatgagggaaagggctgcacagagatcgtgttcctctttctgtctagacaaatgaggtaactgtcctccctgcagcctaggtaccagctttccagcgctacttatttttattttttatttttttttatgacggagtctcgctgtgtcgcccagtctggagtgcagtggtgggatctcagctcactgtaatcttcatgtcccaggttcaagcgattctcctgcttcagcctcccaagtagctgggattacaggcacacatcaccacggccagctaagttttgtaattttagtagagacagggtttcaccatgttggccaagctggtcttgaactcctgacctcatgatccacctaccttggcctcccaaagtgctagggttacaggcctgagccactatgcctggactccagcgctacttataaataccaaacccaacctgaacagacctccacctttttgtgaggtgtttcctctgcgtggaagtcctttactcaggcttgcagagttactccctactgaccaaggttcaaggctaatactttctgtgaaggcctttctgcacctctccctcaatcctttatttttcaaatagattaatcacccattctcctgtgaatgaggtcacatctttgccataggcctgttctatgattcttcaccttgcattctactgactctactgacagtcttgaaactgtccctgtaaattttataaaattaatccaggaagaagggagaggagaaatgaaaataaacccagtttgcaatacatcagcatgcatcatgaggttgactgctctaataccttttcctgatagctgtttgctgcccattgccgcagaatcatgcagtccctgtcacaaggttatagttcctgttaactgctttatagataacaacttaagcactgtgatttgagatattccttcaggtccagcatatccatgaaactaccgtaccaggtggtctgaaaaaccccacgaggagctgactcatcaaagaatgtggtttccacatcctgatgatttcatcccccttactctgaccaatcaatgaccctcaacctccatgatccctgtaaaaaccccagcccagaactcctggggagatgacttgagggttcctgatgtttcctctctcagctgccctgcaatcattaaactctttctctgctgccaacctgctgtctcagtgtgttgatctcttactgtgcagtgcacctacaagcccagtgatcctgtaataggctcgctgcgttactcagtgacatcctggagggcttttcctctcttatttcctttcacagtgtctggtacatggtaagctctcaaagatatttccagtgcattaaaagtaaaatataaccttaattcttttcatgtgaagagatgatagagaagagaagaaaataatcacttcccaagacttttgttaaaaacatgtaaatttatcttatacttaaaaatattttattttagatggttcactttctttcccttgctttttggtattttattttgtgattttgaatattattgtaatatgaaatgatcagcctaaagtgatcaaggttttatattggcaaaaagacatcagatttagtttagcaaatatgtagcatttacagtattcaaaactctaatcacaagggtgagatgggatggggtggaggtgacagttactatagagaagtacactgtatgaaaactggccctgaattatttggaaaatttgatgagtttccatgtaattgtgcttctagctgacaatgtgaagtttcaactgttttagtgtgggaggtggtgacttgctcatccctctgcctctgttttttgaattagtcctttagtcatctaagcataaagcaaattcttggaactaactgtccggtcaagatcactcatcagaatctgcattctgtcaggtaatataaatagtgtgtgattgagtgaggagagctttgttgtgcactctgctgccctttgtggagtagagatatttctgatttcatatgtgcaggctgtattttatactgaataacccagattttacacaatgtgcaatggaaacagagcagagaatctgagagggtcgtctgacttaaaattagatttgttagtgagttttctttttttgaaaacgtaccttctgaaaataagaagtgataatttaagtctttccaaaatggtgtaccctatatataacctctaagagattcctgtataaataaactcaaaacatactgtctacattctactctgcttagaaaattaggtcatgagtacaccattgtgttacgttccacctacaaatattctcactacttctctgagtgatattccttttctttctcttttaattatgaagaaaataaatatctgagcatttgtagcaatatgaaagcatatacagtcaaatttactttttgatctttttcctttcttccctctcattccagaacgctagaggtgactcttcagaggtgacctctattttcagtgggtgtgcatcttcctaaaatccttatgtgtcttagtttgctagggctgcaataacaaaatatcccaggctggctggcgtaaacagccaaactttctcaccatcctgaaagttcaatgtgagggtgtcacagattcaatttatcttaaggcctctctgcttggcttgcaggtgttcttttctctgtaagcactcatctccagtgcctctgtggcctctgtgtgtctacatttcctctttgtaatgagcacactggtaagatgggattagggcccaccctaacagcttcatttaaacttaattacctgcaaatcagtcacctcttgaggtcctggggttagggcctcaacatatgaactttggggaggcacattccgcccacattgcatagatgcagtatcttttgccaacacaggcaggagttcagtacactttttttcttcctgtgatttgttttctgcttaacgatgtaacataaagatgtgattgcagtattccctaatatggataatctgtatttatgacagtattgatgaacatttaggttgcttccaattacttgctgtcatatacactatcgcattaaatatccttggaatcatatctatttaacttatgtgattatttctttaaggatagatggatagaaatagaatttctaggttaatgtgtaggtcatttatatgttgtaataatactgcgaaattgtattctcaaaaggttaaattaatttgtacctgcccaaaaacttcattactgttagctattaccaaatttcaatattatcaatttttaaaaaatttataaagaaaagagatttcggctgggtgtgttggctcacacctgtaatctcagcactttgggaggctgagcagatggatcacttgaggtcgggagtatgacaccagcctggccaatattctgaaaccccgtctctactaaacatacaaaaaaaaattagctggacgtggtggcacatgcctgtaatcccagctactgggggaggcagaggcatgagaattacttgaacctgggaggtggaggttgcagtgagctgagattatgccactgcactccagcctgggtgacagagtgaggctccatctcaaaaaaaaaaaaaaggaaaagaaaagaagtttaaatgactcatggttctgaaggctatacaggaagtatagcactggcatctgtttctggggaggtctctggaagcttcctgctcagaaggccaagcaggagcttacatgtcacatggcgggagcgggaggaagagagcaatagtatcagtatattaaaacaatttgtgtatctgatgggcaaaactcactattttaatatacatttttcttgtaagcagagagtctgaatatcttttttatatgtgccatgtgtaatttagttgctgtgtgtctaaattgtctgtttatattagatacccattttttattgggctgttggtcttttggttattcataataattctttatatattctgactatttgtactttatctgttttacattttaaaatatttatattagatgtgacttatagcttaaccttgtttttgggttttttcgacctagagagattttacatttttatatgatctaatctgtcagtattttccttttaaagatttgtgtgtttgggtatgtcatgtctactaacagacaatggtaccattttcctgtaagttctttggtatgaattaattaaacgtatttctcttttttaccatgtcataggtttagactataccgaagaacttgcagtgaaacatgaaggtctactttccttgtccaacccctcactgcacacacactcctaccttgcctgcctgggcaaccacattcactgcttagcactcagcattctagctctttctctacgcatttacacacgtctgtagatctcattataaagccataaatgatatccaagtacaggtttgcttattttgcttgctttttccatgcaacaggatgtctttgaaactttaaatgtcagtacaaataagtctgccttattctttttactttcttggaaatgtaaaatgtcagtacagataagtctgccttactccttttagtggctaaatggtattgcatagtgtttatcctataatttatttaagtacttctaccatgatcaatatgcagtcatttttaaattgttttgctattaccaaaatttcagaaagtggaattattagttttattttctaaggtttagtctaattttcatctgcttgatagttctttttgtattcagtatgagagttaggagataaggctgtcagccatacattgagcagcccatttttatcaaatttaaactgatattttcttatattaaaaaaattattatgcctaattaattctgcttcttgactcattgttcttatttttcctattgttatgtcaagaccacagttttaattaccaaaaaatgataaaatgctttatctgcttgagcaagttaatctatattatatttttttctaaaagtatttaggtaatttttattatttatttcctaaatggggtagagatagcttgtcaaaatatggaatatttaaaggttattttatactaatagattaatttgggggatattgaccttttagagtattaagtctcccacaataactatgtcatgtctctccttttttttctgtttttctctgatgcatatttttctttccatttaccttcgtatctataccatcattttgatattataaatgggatcttttcctttttacttttttttggggggatggtacagagtctcactctgttgccaggctggagtggagtggcgcagtctcagttcactgcagcctccacctcctgggttcaagcaattctcctgcctcagcctcccaaatagctgggattacaggagtgtgccaccatgcccagctaatttttgtatttttagtagagacgaggtttcaccatgttggccaggctggtctcaagctcctggcctcaagcaatccacctgccttggcctcccaaagtgctgggattacaggcatgagtcacctctcttggccattcttattaaattttataatttgttattgctgctatatcagaaagttattttctttgcatatttatcttgcatcattaaaaaccagtcttgtctctaagaacttaaaaatttatgaaaaaatataaagttaatattcaaattagaatataggaataattagggtgtaattctgtgacctattgtgtaaattaccttcagggttctaaaaggttcaaatacacttataatgaccataaggagcttaatggaggagcaactcaacctgatcctttaggaaaaggcagctccctaagcaatggattacagtgaacaatggcatgaagatgagatttagtatggtatatgcttaaaacagtgattagcgtttcttggcagatcagagagggaagctaaaatccagtgagaataatggatagaagggtagggtggcagttgtgaagactcttcaaagtcaagtggagtagtttggaattaattcgataagtaagggaattcatcctggggtcagagaagtgccatccagacagtagaactgtagaattatttctggcacatcgaatgcagttggaaccagggtgaacttgctaggaagctattcgaatcatacaatctgacagagaaaagggcctgaaacaaggataatggtaaataaatgatgcatttccaaaaaggaaaaaatcagatgaaaaaactgaatatgaaagaagaataaaatacttaaaatatttttattttagtagactagattaagagtagtactgttgtaggagacagaggactagagagactgatatggggaacaggaggatttatttgggtgtacaccagatcagtggattcatatctgaaaagctgagcattgaacaaagactgagtggggtttttataagcaaatttacagaagcagaacaaaagcaatcaatcatacagtgacagatcatgtaatctatagcataactgttgccttagcataacttgtggccttgcatagctagtggacttgcagttgcatcaaaataaaaacagaaactggctaaatacagacatttgtaaaacgcggtcataattattagttcagagaaggagagacagtaaaggaatttgtttttcttttcaactttgctccagagggggctgtctggagaatattcctttggcctcagcttttcagatagtgttatcttataactgtccttgaagtgaactggctaagtagaggaaaacttgtgtttctcacttaacccttgctttattctgtttctctcttttaatttctgcatcaatatgattgccaaagaggatggaaagctgttttagtgagaaataaaaataagtttgggtcagaacatatttagataagcgttggaataatagaatgtatatttgatagaaaactgaatctgggtgatggaattgctgaaagagctcagcagcatagactgcttctttcttggggcaagtcgtcttctgccaatctgcttttgatttgtggtatggttagacttgtcattgttgggtttctattgatgttaaaggggctttgttgtttcttttgttttggtagaaagtaattaaaccagtgaaaaatgattagctggaatttttttttcacagagaatatgattttctaaaaagtacaattatgctcaagttaagctttttataaaaggtatttggtgttctataaagggtaaagacattagactttttttaaacttaaaggtcacatttaaaggggaaaaggtgggaacatgagcaatgcttgcaagaaccacagcaaaggaattattatttttaaatttttttttttatttgagacagggtcttgctctgtcacccaggctggagtgtagtggcatgatcttggctcactgcagacttgacctcctgggctcaagcaattcttcagccactcacgtagctgggactacaggcatgtgccaccatgtccaggtaatttttaaaaaaaatttctgtagagatgggctgtcactatgttgcccagactggtcttgaacttctgggctaaagaagttctgccttggcctcccaaagtgctaggattaaaggtgtaagccaccatgcctggcctacagcaaaggaattatttctgttgatggatagtacaaatttttagcctatagaaattcacaaaatacatgttatctatatatatcataaactgcttctttattttaattggtaaacaagtattgactattaaatattgaaagcagtgagaacatttcagtttcctaaaactaacccacaaggctcaaaacttaagaagaaatatttgacaaaaaattacactaaatttatggaattctagagtgtatctttttcatatattaaatcttgtggaaaaaaccaaagtagcagttatagatataggtgttggtaatatagatgcatcttagacaccctcgtgttaagctcctgattcttcaaaacatattcattttatgttccttggaatattataaaggctggtcagaaaactaacagcatttcaaggatacagaaattcccagtagggacacacatttatttgatagttgattctaattactaaatgacaaaaatagttgaaaaaatatagattacatataagcttgattaagaactgccatcaactttttagacttttttgatgtacaattctatagttttaacacaggtatatattcacatagccaccaccattatcaggatacagaattgtttcttcactaaaaagctccctcaggctgcctgttctcatcaccctccccagacctcctaagcatttgcagtcacttatcatactttaccactatgattacgtctttttgagaatgtcatacaaatagaatcatgtagtttataactttcgtgaccagttctttcactcagcataatgcctttgagattcatccacattgtgtatatcaattcctcattcctttttgttgctgtagtattattccataccactgtttggccattcacccactaaaggacatttagattgcttccagcttttggcaattatgaatagagcagctataaacatttatgcaaaagtatttatgtgaacataatttataattagggtaaatacctaggagtacaattgttgggtcatatggcaaagtgtatgttaaatttattaagaaactgccacactattttccaaagtggctgtgccattttgcattgccaccaggaatataggagagttccagtagctcaatgtgcttgtcagcacttggtatggccagtgtattttattttagccattttaatagatgtgacgctcattgtggttttaatttgcatttccctaatggtaaataatgtttacaacatttaataatgttggacatcctaatgggtgtgaggtgatatcttattctggtgttgatttgcatttctctagtgattagcaatttgagcaacttttcatgatcttattggtcatttgtatatcttctttggagaaatagctactcaagttctttgagcattgttttaattaggccatttcatatttttgttgttgagttatatgagctttttatgtatgttgaacattaactacttatcagatatatgatttcacatattttcttgcactttattggtgctttttcactatgttgattgtgtcctttgaaacacagatgttttagattttgatatagcacagtttttctgtttttacttttttctttgcttttggtgtcaaatacaagaaattattgccaaatttaatgttatgaaccctttcccttatgttttctcccaaggcttttattgtttttgctctaacttttagttctttgacccactttgagttaattttcttatatggtattaggtgagggttcaacttcatttttttatatggttatctggttttcccagcaccatgtgttgaaaaaactgtcttttccccattgaatggtcttggcacccttgtcaaaaattcactggctagccaggcatggtggctcatgcctgtgatcacagcagtttgggaggctgagataggaggactgcttgacccctggagtttgagaccagcctgggcaacatagtgagaccctgtctctatacaaaaataagaaattatacaggcatagtggtgcatgcctggggtcccagctactcaggaaactaaggtggacagattgcttcagcctgggaagttgaggctgcagtgagctgtgatcatgtcactgcactctggcctgagcaacagagtgaggccttttctaaaaaaaaccaaaaatttattggccatatatgtgagagtttgtttctgtgatccccattctattttattgatctctatgcctgtcattatgccagtaccacactattttgagtgctgtagctttgtagtaaatcttgaaatcagaaaatatatgtcttcttactttgttcttttaatgactcttttgcctattttgggtctacatgaattttaggatttttcttcctatttcttagtaaaagtaattgagattttgatagagatggcattggatttctagactgcttcaagtagtattgtcatcttagcaatattaagtcttccaatcaatgaacataagatgtctttctacttatttaagtgttttaaaatttcttttagtactgttttatagttctcagtgtataactattttgcctccttggtaaaatttattcctaagtattttattctttttgatgctatggtaaataaaattggtttcttaatttctttttaaaattattcattgctgctatatagaaatgcaactgattagtgtgtgttgattttgtattctgcaactgtgatagattcctctgttacctgtaacctctcgttttttaaattagtgtgttcagaccatatatgtttggatttaggtctatcattttattattactttttctgtctgttccttctattttccccccatttagcatttcctgccttatttggagttatttgaatatttgttagtattcattttaagttatgtattgtgttttttactacatattttcataatttatttttaatggttggtttagggattacaatgtacttatttagtttttcacagtctacttagaaacaatattttaccactctaagtgaaatacagaaactttatcaccatataagtctctttactccctcccatttatgttgtggttatcttgtgtactacatctgtatacactgaaaactccaagaacaatgttatgatttttgttttctactgtcagacatatttttaaagagtctagagagaggagtagcatattacatttgcccagatattttctatttctgctgcttttcctttattcttgatgatccaagtttcctttggtactttatcttttctgtctgaagaactgcttttacaaattttttcacagtagttctgctggctgtgacttaccagctttcctttatctgagaatgtctttatttcatttttattcctgaaggaaattttcattagctataggtatctgaggtgacgtttcttttcttttctttttctttttctttttttttttttttttgagacagggtcttactctgttggccaggctggagtgcagtggtgtgatctaagctcactgcagcctccacctcccaggttcaagcaattttccttcctcagcctcccgagtagctgggattacaggtgcccaccaccacacctggctaattttgtattttttggagagacaagatttcaccatgttggccaggctggccttgaattcctggcctcaggtcatctgcccacctcagcctccccaagtgttgggattagaggtgtgaactgctgtgcttggccttgaggtgacagttcttttctttcagcatttaaaaaatgtatttctgcttccttatggcttttatggtttccgatgggaaaactcatgaccaattcaaattatttccctataattaatgtgccattttcctctgattgttttcaggatttttattttttttgtgtttagttatttgagttgatttttatatgtctcagtaggaatttctttggatttattctgttggaggtttgatgaaatttttgaatctataggtttctgcctttcaccagacctgagaagttttcttctattatatcttcaaataatttttttctgcaccacactcttttttctctccttcttaagcactggtgacatgattattataaatttattcttgtttcacaggtccatgagactgtaaatttttctttattctgtttttaagattagataatttctttttttttgtttttgagatggagtctcactatgttgcccaggctgaagtgcagtggtgtgatctcagttcactgcaagctccgcctcctgggttcacaccattctcctgcctcagcttccggagtagctgggactactggcacctgtcaccatgcctggctaatttttttgtatttttttagtagagacagggtttccctgtgttagccaggatggtctcgatctcctgacctcatgatccgcccgcctcggcctcccaaactgctgggattacaggcgtgagccactgcacctggccaagattagataatttccattgatctaactttaaatccactgactcctctttctattttattgaggcagtgttgctatttcttgtttgtcaatgtatttttcagttttaaactcttaatttagttctatatatcttctgtttctttgggagagactgtatatctttttatttgttgaaagagtgtttgcccttactttttgttacatcatcacgatagctgctttgaagtctttgtcacataatgtctacatgtgtgatatctcagtgttggtacatgtttaatgtcttttttccacgcaagctgagatttttttagtttttcatatgctaaggacattttaaacattatgagatttcgggttttgtaatctatgtaatattaatatttttgttttagccagcaattgacttggttggatgcatgtagatggttttcaccagccttgtgtgggttttggttttaatgccagttctgcttttgaggatttttcagtgctatgtagatctttcctgtgtgtgcatgacccagtagccagtctgggaggtgattatggtccatccaataggtcaattcttaaagtctttggtgtgctgtttagggtcagatatatgcatgcatattttgggcatgagcccagaagttcatagacaacttgatgggatttctatcccatgtgcctcttttttcataatctccttagaatcttccagttccttggtgttctcctttaggtcatcttgctagaaaactttggctctacttatcccctgtgttgcatacttccagccacttccatccacgatgccttcattcagggtcaagtagtagaagagagagaaaaatggaatatgctttccattcctaattaattatcttgattagagataagtttcccatctttcagaattttagttatctgtaagcccctgttgctgccactatcactaacaccaccactatgggatttcctgtggacagggacatgagagaatggagaaaagatgtaaaaaacagatatttttccccatgtgtgtaagtattagaatttctctttcccactccttgaaccagggctagagggattctcatgaagttctctgtgtctcatccagtgtccttttctcattttggggccaccttgagtctaggagagggtatactggagggaaaataagaaactagtcactagtttgcattagggaagaaagaatgaaatgggctttttctctcttacctggaactagaaccatcttgtttcaatgttttatactgtttgtttgataaacatcaatttattttacattatttgataaacacgattgtttcatcatggcttgcttaaaagaatgcatgatcaagaaagtttcccatggctgggtgcagtggctcatatctgtaatcctagcacttttaagaccagcctggccaacgtggtgaaaccttgtctctactaaaaatacaaaaactatccaggcatggtggcacacgcctgtaatctcagctacttgggaggctgagataggagaatcacttgaacccgggaggtggaggttgcagtgagccaagatcataccactgcactccaatctgggcaacagagcaagactctgtcacacacacacacacacacacacacacacacacacacacacagagtttcccataaaacatttataaattagaaattaaacttatttaaaaataatgaaaattatttttaaattatacagttgatatagcaatagtttgctttgctatagttaattaggatggataaatctaaaaaatttctctgaccaaagcgtcccatctatctcccttccccttctgttatggagtgaatgtttgtgtttcctctctcccccaactgcccaaattcatatgttgaaatcctaaccctaaatatgtgatggttttaggaggtacgtcttttgggaggtgattaggtcatgagggtgataatgcccttatgaaaaggaacccagagagctctcttccttttttttttttttctcggtcatgggaggatacaaagagaagtcaaaagtctttaacccagaagagggtcctcatcagaacccaacaatgctggcaccctgatctgggacttccagccttgagaactgtgagaagtaaacttctgttatttacaagccacctcatctatggtactctgttatatcagcctggacagactgaagcaccttctcagaggttactgctccaaacattgtctctcaacatgtctcagaggtctagccatataattcagatagagctattgtacttttaactgattcgtttatagttttaatttaacttagtgtattaagccattctcctatttagatatttagattttttcaatgaaaacctgaatgcttacttagaaagaatagtagcatctgtattataaataattccagagctggcagtctcatatagcctggtgctgtgagttttaaaggtgtttgttgaaatttttgatctggttggacctcacattttttgtttttctgtgttgagccacagtcacaacactattaagccatgtgtcaagtccctttactgaaaagcaatatggtaaattgaatgccagtgaaaatcatttttaattgaatttctatagttttcccaagagtataatgaatataattggctaagtccgcagccacaaaacaaaacaaaacaaaacaaaacaccagtgtagaataatgcagcttttcctctaacagtattttctatacaaaatggcttttttgccatactatcaatctttttttttttttaaatcatggctctacttcttggtttgttgagaatgaattttacgtaggctatgatgttggtattctctagaatttcatgcatggagtacctaacacatttagaaaccattcacaaattggatggcatgtggcggattgaaccctgagcttgtctctagcccttctctaaagcccactggaatgacagtaaaggaacaaaaataatataatccatgaggacaaagagacaagagaagtgacagcagcagaccagagacatcgaagatgtttggaagagcaaatgaaagaatggcaattacttagcagctgaaagccacagtggaattgtgtatatatctctatacagagaaaaaagcatggatttttgtcacagaaccccagaaaatttcaggtgataagagcaccatggaagagcaggtaggacagaaaatctttaacatgagaataacctccacgcaccccccaacccccgccccctgccttcctaagctcacatgaacggacgctccctcctccatcaaagaatactgtagggtcattctctggaaatactgaatgagaaagctcaagcctcaggatgccacacagagctggggcttcagggagatgccgtgctggggagagggaagggaagcctgcatgctgcaggaggagtgtccccggacagcggccccgcacatctcctgggatgccatcgcccaggttcatgctctctgagcatgaaatcacccaactattctctggagaaaatgattggtcccctaaaaaagcttctcagattctgacaagaaggactttccaatggaatgacaaagtcccaacccagtccctcgaaataaagctcaaaggtcagtgtgtgtgcccaagcactcagaattcactcattttcttagtgtcttgttcttaaataggaccatcagcaaagacgcccaacacatttgaggaaaatcttcaacatgaaagtagagaacccccaaaacaaacaccaagagaggacaatgacaaaaatgcagagagcagaagaaacttcaagaaaatatataaaaatgtctgcagagagatttgatatcacctatatgaaacaagaacaggggttataaaaggaaggagaaggagtgctcagaataattaaatataatgttataaataataaaaaaaagtgttgggacagatttaaagattcttacaggatatttaaaaaaccaaaaaactggatgggcatggtggctcacacttgtaatcccagctctttgggaggccgaggtgggcggatcacttgaggtctggagttcaagaccagcttagccaacatggtgaaaccctgtctctaccaaaaatacaaaaattagcctggtgtagtggcacatgcctgtcatcccagctactcaggaggctgaggcaggacaatcacttgagcccaggaggcagaggttgcagtgagccgagatcatgccactgtactccagcctgggcgatagagcaagactccatctcaaataaataaataaataaaaataaaaaataaaaaaccaaagagacaaaaaataggagaagaagaaaattaggtgatttataagatgtttaatgtacttaaaaagattttcagatagaacaaacaaggaaaacaaaaagaatgatattatttttaaaaatcaaaagaaaataaaagaaataaattcatcaaactagggaactggatgtgtgtggaagtcctgagtccagaaaaacagaatttttctttcctcaactattgactcattatctaccaggggaagggcctgggtgtgcctggtcaggcgtctctcgctgctccagctcagcacaaggagcagggcagggaggttgtgtgccacttgctctagacagcatggctctgtggaataagtgggaagttaaggtaaacctggagaaggaaatactgaagaaggatgtgaacagagagactgatgtgtggaatttcagggagtcataattagtaataatcagtcatgaaatcagaggaccacctaaaatgactattctgcttgaccatcacaccagctctttggctgataatagcaggcaaatgtaaacataaattaggaaaaaatttcaacatacaccatttcctaactaggaagtggtgcaacagggaacagcacttgttatttgcaggacagtggctggggcgtgtgtgtgtgtgtgtgtgtgtgtcaggagctaacaggcatgcaatgtgggcagaaccaaattgaagaaaagccagcagatttttgttcccagatctgagttttgggagcacagcaggtagcagaagccatcaggataaggaaaggccgagtctctggcacatccggctgcatctttctctgttcctgtccccagacgggcaagtactgcctgggaaaatcagccagcaaaactagagccaagatggtggcagtgcctcagtattttcagaggctttaatgctttctctgtttccctactcagggttctctcttatggccttcacaagtagctattttatatttattgcatactctgacacctgctttttttttttttttttttttttttttttgatggagtctcgctctgtcgcccaggctggaatgaactggtgcgatctcggctcactgcaacctccatctcccaggttccagcgatcctcctgcctcaggctcccgagtagctgggattacaggcacacgccaccacacacagctaattttttttttttttttggagacaaagtctcactctgacgcccaggtggagtgtagtggcgtgatctcggctcactgcaacctccgcctcctgggttcaagcaattctcctgccttagcctcccaagtagctgggactacaggcacatgcagccacgcccggctaatattttttgtatttttagtagagacggggtttcaccatgttgcccaggctggcttcgaactcctgagctcaggcaaactgcctgccttggcctcccaaagtgctaggattacaggtgtgaaccaccgcgcctggtctcattttttattagtagtagagatggggtttcaccatgttggccaggctggtgttgaactcttgacctcataacacctgctgtttactaaatattggaaaataactttactccccactttatgaagaaaagccataccataagcctttattttcttgtggcttctattcccatctgtgtattgatgattttttacatctgtaactccatcccatatgttactcccgagcttgattgagttccataggcactcccaactcaacattcctaaaactcagtttcctactcctcaccacccctgtgatcagctccatccatcagcactcaagctggaaacccggggagggatcattcttgatgtttccccgcccctacactacttgcccacatctttccactgctgtgcctcctggaacccacccttgttctggccatctcagcttttttgcttgtttcccctcagctcttctgtccccaggctctcacacccagatgactccctgcccaggtcttgcccagctccagtccattgtcccaccctgtggctagaaagatttttctaaaaattcctgtttcctttatgttcttatgcaaatcctggatggagctttgagataggaggtgggacttgactctagaggtggggatagggcattggacccaaatgaggactagctaaaacaggaataggctgggagcagctttccataagacacgcacagcagtgtgctatgtcagtttaccattgccatggcaacacccaggagttaccacccccttcccatggcaatgacctgacgacccaaaagctaccatcctttcctagaaatttctgcatagaccaccccttcatccacatgtaattaaaagtaggtatacatgtgactgcaaaactgccctgagctgctgctctctgcctatggggcagccctgctctgcaggagcagtcttggagctgtaacactgctgcttcaataaagctgttttcttctaccctaccaccagcttgcctatgaattcctaagtgaagccacaaacccttacgggctaagactcactttggggctcatgtgtcttgcctcagcttctctactttacttgggaaatcccaagtcctaaaccctagagttcaaggacttcacagttcctcactgtttacctctccagaatcatctgttgttgctcgctgtacttagccatgctagaggataagaatcctctagaatgcttattttaaatgcaaagtcttgagaatatggtttagtagatgagctccaagctcaggaaacttgtttcgacaagcactctgggtgattcatatgtagatggtttataaaccacacctggagaaagcctgctgctcaggtggtacctgggctatttcttaaagtttcattctctgtttcacctttagcatttccacatgctgtgtccattgcctagaacagacttctctgtctcctcttaccccttccttacccccagcccaacttggctctttatccttccctttcagggtgcagtttacaagtggtgtcttctgggaagcccccacgatcctttcaaagcccaattagtagactccctttctttgtacatgctgaggaacttgttacattgtcactcctgttcactctgttttctctgcttgagctgaggagctcctgcctttggtgacccttccaacttgggtattttcaaagaaagggcagtgttgtaccagcaccagcaccattaaggaagatgcctatcacttggcagcacaaatgctactgacattacatggtgatgcatggttttcatcctttccttcaacataatgccaaaggcaaatttctcttaacctgttatacatcttgttggctttgcttgggaagaagcaggggatatcccaacaaaagtctagtattgagcacaggattaactaactttcaacaagacatttcagtagaaggaaattaactttgcttattaagtagatgatgggttttttgtaagcatatttttaaaatttgaagccttatttgtccatgatacttaaagatgaaatgaagaccttagatcatttagggttatttgtttctgtgtttgcaggtttccattggaagaggggagcacttctggcaatagctaaagctattaaccatcgcatgaaaaagatgattaggttttcagctttcaagtgagaatgctgctactttaatgcccaaatgtatcaacatcggcaaaatcagatttagctgaacaattataatagaatgggctgcgctgccacccatgcttttagatgtccagggtaaaaataatttcccctcaagcctaattttcgaattgtttgttttattttccccataaaatagggaagaactgtgtgactcaatttcaacattcctgtatttattatcaacatatttcacccactcctacctggcagggcatcaggtttgtgcaatcagtgactatcctgggtcttgtcaattgagctgttgtttggcgtgtggaaaccagagagattcacttcatgttacactctgggctatgtgcagtttattgctttctgcatgttaatgttgggtggagagaactttaaatgtgtcatagattggattttaatgagaaaaataaaatcaaaggaaagggagaaactgaatgcaacatcaggattttaaggaaaacatttcttgttctgatttgattttatttactgcaccaaatgcaccatgtgtcaagcatattctattcaaataagatttatgaagtactttttcttatttatttatttatttttggacagagtctcattctgtcacccaggctggagggcagtggtgcaatcatagctcactgcaaccttgaactcctgggctcaagcaatcctcttgcgtcagcctcctgaatagctgggactacaggtgtgaacgaccatgcctggctaattaaaacaaattttttttttttttttttttttttgtagaaacaagatctagctatgttgcccaggctggtcttgaactcctgggctcaagcaatcctcttgcctcagcctcccaaagtgctgggactataggcatgagccacgatgcttggcctgaattatgttttaatgaacggtgtcatgttggtgccttttccaaagcatttttgtttgatgtgttcaatgccatcattggcacttaacactcttcccaatagttttcatagatacaccatatttttgtggcacttattgcagcatttttttttgttacataaatatacagaaagtgtttagcaatacaagatagctgagttatgccattaaaaatgtatgcacagtccctgcatgcatccaaaggatgctgagcaaccagcatggctttcatgtgtcctgtttctgcccttagtatccgttatcttcctgtgtcctagaggccaaagtcccaatgctagacctagtggtccggagttcaccaggtcatccctcctggagccactctctcccacagcacccaattgctccaacataccttctctctctttgaaacagtttcacaacaagaaggtgctggaaaggaaactatgtatttctcacactgtgctgcttcgcacctctgtaactttgtctcaaaaaacccaacacagagtgttgttggtcattcagtgggaggcgccaatacttttctctcaagtttttaaaagatcactaagtaaagcatgcaagtgaatattcacatattcagcttctgtttatttttattatttttttttagtgatgggggccttgctgtgttgcccaggctggtctctaattcctggcctcaagccatcctcccatctcagcctcccaaagtgctaggattgcaggcatgaggcaccacgcccagccctcagtttctgttttaaaatatctgactttgttcatgcagagataatctcataaatgaaagatgattaaagttctaatgagaacctgtcaactttctaaccttcaacttcgcttacctactctttggcatgactatcttaatctagggatccaaaagaactttggatattgttacccagcaacaagctttaaattataatgaggttaagtaagtttgcccagaatccacattgtatcaacaacagataccttgccaggattaactaaactccattaacttgaaaagccctgtaagtcaagattgccttcttaagtataaataaatataatgcttcaaagaaaataaatactgtgatgttttgagtctttactgtatttgaaactctctatatggttattgtgttttttttttctcctcctattcaattggccggtggtttgctcttgtccccactcttcacacacatctactcaattgctaagtcctgtcagtgctccctcctaaacatctggaatgctcactcgctactcatgtccaccttcctccagccctggttcacactaccatcacctctcatttaccaccttgttctctgtatctagtatgaccagaatgtttacttaaaagaaaaaaagaatcagtccacaaagatgaaatgcaaaccactctaatttggcttagacttttctgtttctgtttctcattctcaatagcactggaattttctgtggaacatcattttctgactcccaaagctcagagttaagacagttgtgaaaccaggaggtcgaatgggacagaatgggaaggattcagtcatatacttataatcttgtttgtcttttctgtggcctggaacatgtgtttcctgagaattttaagaaagggctcctttctcatccagctgtccacctgagttggtgaccctatgtgtctgggtggcaggcaggtgtggcccacagcttgcctttttctctgggtcatgctcagcaccagtgaggcaattgttttttgcctggggaacagggccacctacacccctgaagatgctaaatgggtgttattatttgataattttcagtgatctactgttcttactaatggagtgatccagtgttcactatgactaatgttgacttcttaatcattagaaagtttaggaaaactagtattatattattaatatataattataactatacaatacataattatatatattaatgtatacaaaatatgtaacaacataaaatatatatttggtgcatattatttcaaaaagttgagtagtttgttgtaatgaatgacattattggcgcttttcacattcttaaaatatttttgtttttgttaatatatatttggtgcatattatttcaaaaagttgagtagtttgttgtaatgaatgacattattggtgcttttcatattcttaaaatatttttgtttttgttaatatatattttattgtcaataaaggccacatattatttttgccaaaaaaggtattagaaaacaagtttatttattttttaatttttgatatgggatcttgttctgtcacccaggctggagtgcagtgacccaatcacagctcattgcagcctcaacctcctgggctcaagtggttctcctgccttatcctctcgagtagctgggattataggtgtgcacaactgcacctgactaattttgtattttcgtagagatggagtcttgctatgttgctcaggctggtcatgagctcctggcctccaatgattttactgccttggcctaccaaagcattgagattataagcgtgagccactatgccaaggctgattttgatttttaaaacttttttactttgaaataatttcaaacattcagaaaagttgaaaaagtagtataaagaatttctgtattcaccaggtccttgaataacatcattctgttataacattgatgagaaaaaaattgattcctgccagggtccactgtttgtggagtttgtatgttctccccatgtctgcatgggttttcatctctgggtccttggacttcctcctgcatcccaaagccatgcacgctggtgaactgctgtgtctacatggtcccagtgtgagtgtgagtgtgctttgtgataggatggcaactgtccaggctggttttcacttcccgacctgagctgccaggatggctcctgccacccatgacactaactggaataaatgggttggaaaatgaatgagtgaatacaaatgattataaagcaaacattcctaaagtctacgataaccacagaaatgcacaaaaatagatgacgcaatatgaacatgctcagtgagctgccacatttgtgattgcttttgaattgtgtggtgcaaggagatgctcttgacaatttttgctttgcaaacatttattccttgatttaacccaccaccgcttcgatgtcatcactcactgagtcatcaaaaattgggtaaataattctttttcttgtttttatttacctttattaaattaatgaagagttctcatttatttaagtgagaattgaatacatttatttcaataagcgctctccataaatttaataaagattaataaaaacaagaaggattaatagtaaagtgttttgtgtctttgtttagaagtttgatgatgtttttatgaccagaaatgtgctgtaggaacttaactcttacttatatcaattaacctatgggaaaactggtttcattatatgtcatttcattcattgtctctgtttccaagaacccattgatgacattcagtgaggacgtactgtagtctctctctctcatctccctccacccacagcattattattattatatatttttctgaatcatttgagagcaattgctgacatgctcttttaccctaaaacactgctgtgtgtgctgcctaaaaacatggacaggctcttgcataacaggtacgtccgtccacatcgggaagtcagcatcaatacagtgccaccacccagacctcactcagatatcaccagcggacccaaccatgttctttgcaatccccttttctcttcgggaataggattcaatccaggatctcatgctgcacttagctttcatctcattttgttttccttccgtctagagtagttcctcacattttccttgtcttttgtgatgttcatatttttaaagagtagaatccaggtgttgaccttcatttggggttcagctgatgctttgtcacgatgagattgaggtgatgcatcacagaagggactttttaggctgggattggccagtccacaccgctttgcacatgacttcagatgccctctggagtgatcatgggttttgtgagtagttcataacttttttctctcctgttccttttttaatttttaattttttttttttttgagacagagtcttgctctgtcacccaagctggagcatgcagtggcgtgatatcggtggctcactgcaacctccacatcccaggttcaagcaattctcctgcctcagcctcccgagtagctgaaatgataggtgctcaccatcacgcctaatttttgtatttttagtagagatggtgttttgctatgttggccaggctgttcttgaactcctggcctcaagtgatctgcctgtcttagcctcccaaagtgctgggattacaggcatgagccactgcacccggccaagttctcactaatttttgataagtcaaaagttaacctgcccctgtggcctggcatccacttcttcagcagttcctatccagtgccactaaaaggatccctcatcactttgctaataagaacatcctctatgagtcagcattctggcatctcccagtttaaatgcacgaactccagcaaaacccaagaccaactacatgagattttgcattttaacaagtttcccaggtgactcatacacatattcaacttcgagaagcacagctctgggaacataaaatctgcattatttcattaattttttaaatatcagatattttggaatgtgttaggcaatgtgggagcctgtgggagaaggagtttgctttgttacttttattttctgatcttggacaaaatgtatttaaattttgaatacattttatacttctcctttaaactctgaaacaaaaatcttcaacctcaacagttctaattcacttggtctagtgtgggtccccagcacctatattttctaaaggctcccccagcgtgcccctaatgtgcacctaggttgggccattatcacaactctaacacatgtggaagtcacgaattaactgcataaacatacagcaatcataggaataaaatacttccaatatcgtggcctcttaatcctagaacttttctccagtcttttatcttcctctctattttattcccattcaatatccttgtcatggttaagaaatgtgccccttccaaataccaattgcaaatatttcactttcagaccactagctcctgtctttagctcactctctgtagtgcctggactccaatgttcctgggccttactgaacccctaccagctatgcctccctccacaagttcatgtttcccaaccccctcacagcctcattgcctgccttccacagtgggggcttcatcgcccatcatcagtgactcctcccttggctgcacctccaattcccttgccctcacttacttctcaccacttgcttggaaaactccaaacctggttaaacgctgctctcttcctgctcactctgaaccgtgtagcagaatatgccataaaacaaacaaacaagcaaataaaaaaatcccagatcatgttgacccaacaactggtctcactttaaattcaaccacctctgtccagcagttccactcctttccctagtccaataactcgcccttgtgctagatgatgatttcctaccttagtcattcttcccagacttacagctcctccttcctgtccccactcagtgatgctttttcttatttctctggaaaaaaaaattaaaaaaaagttctgcaagctgctaccatcacctccagcctcctctgcacctgaacacgtttccttggccttctgactgttcctgtgcccacccaagaccatgccctccacttatgctctggatctggtcaagccaacctttgctgcttcttctgggtcaccagtttgtgtccactgaatcattttcatcaactttcaaccatgctttttcattccatttaaaataaactcttcggccccaccctcccaggccagctactgcccctctgctctgctttgctgtcttgtctttctgtggaaagcctctctgaactcattttgccatatgtgtaatggaagagaatgggatagagagagagaaaagctaggaagagagattagaggggaggcagagagtgggagggagaggttagaaagttaattctgattcatttaagtttataatatgtaactgggtatcaatctattctaggattcacttatttaacaactatttattggttagcaggcattttttttttttaggtgcaggggatacagtaatgaacaacagaaaaagaaatccttccccttaaatgagagatcgggtttcaccatattgaacaggctagtcttgaactcctgacctcaggtgatccgcccacctcggcctcccaaagtgctgggattacaggcatgagccactgcacctggcctgttcaagagtttttatatcacttaatctctacctcctcttcctcttcccagagcccagtgagtggggctgaaagttccaagaccctacttacttggtctttctggtgaccagccgcagcctgaggctatctagggatcctgctctaagtcatgccatttgcataaactcagctgtgatgaaagctgctcattatgaattacaaaggacactcctatcactcaggaaattccacgggtttcaggagctctgtgccagaagccagggtcaaagaccaaatatagttttttattaaaatcatagtgacctttccttccttttcatttcataaaagaatatcctttggatattctacctggttgtctttaatccaatgaaagattattgatctcaggtcagatataactccctttcctctgtcctaattaatgtcacttctagagacatttctggactgtagtttctagtgggtttgttttgtccattatcggtttatttttaactgcctttctttcaaaacagttcctatttattctttcattttcagtcacaatatgtgatagttttatggaacagttttctcctttcttttaaagcctatagatgatgacatttaataaatgacatcagatctttttaactgcatgatgttatcacatagtgattcttatccacctccatacgttgtttctaattgctcttgtgtcagacagttggaagctggccccgaactgtgaactgtgagcagcgtggggaactcagccttgcctctattaaagcatctttgtcagaagactaaatttttaaaaagctcttttgcatcactaaattagaagagaccatatcaaataatattcactgctgatgagatggagttaaactgatactcatgcttccttggcaactttataaattcacacaaacttttggaaactaatttggcaactaattaaagagctgagaaaaccttatttaaattatttaaaaaattctattgagacaatctaatatgggaaaaaacttctctaaaggagaatgtttattgcaaagttagtgaaaagggataaaaatcatagaaacaaatctccaaaatggaataataaataaata

SEQ ID NO: 73 - DNA, 124385 bp, Homo sapiens
actaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggc

SEQ ID NO: 74 - DNA, 19481 bp, Homo sapiens
aaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctca

SEQ ID NO: 75 - DNA, 144143 bp, Homo sapiens
tgcaatgacgacttaatcatatgcagaaataagtagagaattatgcatcaagcaccaagatgattaagtggcaccatcagccaggatgtcactgatgctgtaatatgctgccgtgggtttgaaagcagaatgagtcttctgccgtctttcagcaccacgagacccaaagagcattaggagatcatgcgaggggccaaagcatcatttacttcttattgagttcattctttcattgtgccctttcttgctatttttcaatactctaccagggatcaggggtacactgacctcttcccacttttcttagcaccatactcttactgaaaagactggggaaggggtgggaagacacgacaggggaaaggaaacttcaaacttggatgattcatttaattactgtggtgtaaacacaaatgagaaacaacaagagtggtgatttaccctgcagaataggttggcaaaccctaagagactaaaaactaaaataaaacattctgatacatgcatacttaaagtaagccaacaataaataattcaagcagcatttacaatgacaggaaataaagagcgggcagaactctcacaatagtttcatccaagtcactccccagtatctgtgtcagctctctactctctcagggcaagttgaaggcatgataggatatcaccattttgcaaccagtaatgaaacaactgattctggcaaggatcatcagtggaggctaaaactacattaggttcctggaacagggtattcatgccaaagtatcatccctcagactgtctgctaagctaactgaagaggggaaagagtgcctctacaatggagatatctggtggttaccgccttcatcaagtgaccaaatttagcatctctaatagtgagacaatctgacattagatgcctttgaaatatgcaatatgaaatacacaggaccacctatgaaatatccttgccaataatacttaactgaatataatcaaacctttagaactaatttccactttccagaacatacaaggaatagaaaacaaatttaaaaaaaaaaaaaataaatcacaaataagtaatccaaagtactggatattctacaagacaactggcctggtctgttcaaaacagtgtgtcaaagaatgctgagaagtggggaggtggaagggaaatgtaacaaccaaatacaattagtgacctctgacagtcaagcaagtcaccttgggacagtcagggaaatttgaatatggactggacattagacaatactaacatccctccctatttttagctgttggaattatttgaaaacaaaagcaggacaaatttagtcaatagaatcgttatcttttaaggtatgcacaatgatatggtgttacttttattctggcaaacactagtaactaccaacacatactatgatgtagggttcacaaaattctagcctgatccatactatgtactgtctggtgaagttttttttatcttccttgagttcatcatttctcaacgtgtctttcagcaactgaccagcaatctctacaacttcttgctctgccacaaataaaacttatttatacaaagacagtgtaatggtttctgtcacactgtctggttatatctctttatcaagtatctgtatgtctttatcaaactgttccttatcgttaattctatccaaagccttagtcataaatccagtggaattttcaggatttttctcactctgtcacatctggcatcacagattgcttcttaaaattcttcctctgttggaaatacactctcaacactctcctttacgtagcttggttaagtcctattcattctttttattttatgggtttttttttttttttttcaagacagggtctcactatgttgcccaggctgatcttgaactcctgggctcaagtgatactcctgcctcagcctcccacagtgctagattactatgaccttatttaaccttgatcaccttctcatggaccttaggggttagagcttcaacagaagactttgtagggagcacattacagtctctgcaagccatggacatggtgacaattttattccattctaactgcagattaaattaacctccatgttaatctgcagcatgttttctttctttctttctttcttttttttttttgagacggagtcttgctctgtcgcccaggctggagtgcagtggcgtgatctcggctcactgcaatctccgccacccgggttcatgccattctcctgcctcagagaatcttattttctgcacactgctgtgtataaacatacatttttttatatatgtatgtatatatatacacacacacacatacatacacacacacaaatatgtagtgataaaactatatagatgatatttccataattaatacatgtttatattaatgtcaattttaatgtatgaatatgtattaaataaaaacccatttcatttacatatacatgtatatccttccttccttccttctttcatttattattttttattttcatttatttattttctttttgggcctgcctggtcttctcactctgggctctggtgacctcagcctcccaagtagctgggactacagggatctcttaagcccgggaggcagaggctaatgtgggctgtgatcgcgcacctccactccagcttacgtgaggtggggtgaggagaggcgaggtggggtgaggtgaggcgaggtgaggtgaggtgaggtgaggtgaggtggggtggggtgaggtggggtgaggtggggtgaggtggggtgaggtggggcgaagtggggcgagggggcacccggccctattagctcttgaaaacaagttgagatgtgatttccccagaagacttccctcgcaaggacctgactgccaccaccattctgtgatatgccctgggctggcctctatcacattcaaaacaccgtactgtaactatgtacgtatgtctgtcttcctactagacatgagttttttttgagggccaaggctctgtattttatttctgtccacttggcgtttagaagtacctgagacatagaaaatgttctttgagttgatcaatgaattttacaacaataaagagaaggaaacaggctcaaaggagttaagtaatttgcttaagattacacagctaataagttgtgagctaataactccagccacaggtcttctgattctaaattcccccaaacaccaccttgtgcaccatcaaccatttgtgaagactcttcatttacaatacaaaaattaaccttttcttgggtattccatgagctgggaatgtagaaatagactaggcaagaataattttcattctatgtttaagcagaagtaacaggggttctcaagaaacagaactctgagagatctgtccagcctcagagccagtgttttaaagaagtcctggagccttaggccatatatgggtaatctagaacaagtatcttcaatacacatagcgtgtgagaaactttttgttaaatgaataaatggagaacaaaaataaaatgaaaaatgttgatcaaaggggacaaagtttcagttaggaccagtaagttctggagatctatcatatagcatggtgactgttaatctactgtggagtaaacttgaaaattactgtgacaaggctgggcacggtggctcatgcctgtaatcccagcactttaggaggccgaggtgggtggatcacgaggtcaggcgttcgagaccagcctggccaacatggtgaaacaccgtctctactaaaaatacaaaaattagctgggagtggtagtgtgtgcctgtaatcccagctactcagaaggctgaggcaggagaatcacttgaacccagaaggtggaggttgcagtgagccgagatcgccactgcactccagcctgggtgacagagcaagaccccatctcaaagaaaaaaagaaaaagaaaattgctgtgacagtaattgctgtgacagtagatgttaaatgctctcaccacaaataaagataagtgagaagctacttatgttaattagcttgagttaatcattttacaatataaacataacaaagcatcacactgtacactgtaaacagatacaatttttatgtgtcaattgtatcttatcaaagttgggaagaaaaacaactctaactcctggtttcactgataggtcacaggtgttttcagtaccttcggtgactcaaaacaaaaaaataaacttataaggttctctttccaaaggaagtaactatttggttttaactaaaacacaaataatattaaataaaagaaatgaacaaacaaaagagctccccaaatcaacttatgtatcagcttagaaatttagtatagctcaaaaacagaaagaaagttattctctttcctatttaggtgatattggtgactattttcaaactaaattccaatggctaaaaaactatgtgcataaatttattttcttcttatacaccactggttgttaaaatgagccccttactaaaattactttaggagacacattgattattgctgaaataatgagaataaccaagaatgtttaaactcccccagacagatattcatggaaagtaaaagcaagctaaatcgaactgcactaagatatattagttttcttaggggaaaaaaaaaaaatctaaaaccctggtccagcatttttttcttaaaatcaattatgtttactaaatgaaaatagaacatattgattgactggttgagacagggtcttgctctgttgcccaggctggagtgcagtggcacgatcatggctcactgcagcctccagctcgtgggctcaagtgatcctcccatctcagcctctcgagtagctgggactacaggtgtgctccaccacgcctggctaatttttggattttttagtagagacaggttttgtcatgttgcccaggctggtctcaaactcctgggattaagtgacccacctgtctcagcctccccaagtgctggggttacaggtgtgagccactgcacctagccaaaagtcaaattaaaatttgacctttgactaccactaagagtatcagtaaaaaatctcatttcaaaaattattttaaaaattagaatgtccaacttgctcagtaaagatcgacttatataagtaatgcaaaatgtattactaatacaatgagccatcacgttcccaagatgtaaattagtcaaataaacaccaagtatcatagttacttggataaagtaactcttggggaggggatagaaaacatttcctaataaaggttatggcaaatgattttcttgtaccatctctaagaaatattagcatatataccctttccttcttgtacaaagaaaaagtgattcaatgaacttgtcaaagcatagtttagcaaaaaaagagaaaattcaagtgtctgctttggcttacatcttcaggcaactccacacacagtccacaataattcaggtattaatcctactgtaagtaagtggactccattgttccagaaagaagcaaaggaaattagattgtgataaaagttttttaaaattggaaactattgaaaattaagtaggactttctgcaaaaagctttactattgcattcactgcagtatcacaagtaaaaatcaaatggttaggtctccttatgatgctataataaagaaactggcaagaggatctggcatacttagagaacaagtttctaagtgtgtctgccccatcaaatgtgagtttctaaatacatttgctaatgaagtggttggctagagaaatgtaataaatcagtataaagtcagaacatttctttaaaagcagcaagattataaacagtgtaattataaaatactatgaaaaagtgctatacttggatttcattgttagttgctttaatggggaaaggttgatggaggagaaaaggttaaaaactgtaattgggccatagaaaacctctttctaaattaatataatcatcaggtaaatttcattaagccagatataattaaatgcattttacctgtacacagataatgtaaccatgtaagtttccttccactgaaatgttggctataaaataattcaaactgtaaaaaaaaaaaaaaaacacacattatttttagctactataacttgcctagttaattaacacaatactacaaaagcaatgaaaaccattcatattagaagagacattaaagcccatctggtttacctccttcttttacagaggagaaagcacgttcctgtggtccctaatcaaggctatacacatatattccagctcttttaattgacaacttgttctagagttctctccactaaaccacagcactgcaaatttgactttctgtatgacacagtgattcattatcatttctgaataatactaacatggactttataaattctactaaccaaacacagcaacatatatatttcaccatgaaaagagaaaccctaccttcatctctaatctcccatttgccaacatatagcttccacattcaattagacacaaatacgaagttttagggtatatctctggattattcttttgctgatattattgtgaacaattaaatttaaattctattaatgtagccttcaaattttaaacattcctccctggactgaatgtgtaattacagaacaaaaatacagagttcttttttctttaataaagagctagtatacaataaaaagtggaaaaatgatactggatgtgaaaaagataaaaactcaatttctttataaaactaaaaaataaactgcattatgccagttcagaattctgaataaacttttagcatgatgtaccatatataacatacttaaagcttttatttgtatatcaaactttaccttttgtactttaaaaaggaagttcacataaagcagtcagcaatgactgacctatcagctatattatgaccactccttaacagcaaaagttaatagctccagccaagaaaatgagtcaattccttcagcagttactctaagtttgcctagtcctgggaagctgaaatatgttgagcctattttccctctaatggtgcagcatcctcctctaccagcagatccaccaatccctttgcaggatgaacaggagatgactagcacctggaatacttcagattgcctgcttagttctaatccagacaaacagcaaattgaaatatgtcataagaggatttcagaagtatgatctgactaactaataactcccagggatatcaataaaattcaatcactactatataattcacaatttataacacatttacaatgaatctggacaaaagcaaaataaaagttaaaaaaactttcatttttttctcaaaacactttcggaaatgagaaattccagctttaaaatgctcataatttaaagtgcaaagctggctttaaaaggtatattccaagctctaaaaacatgttttacctcttcagtagtactatttggtaaagttttattgacgataatatcaatatgccaaaagaagatactgattcatccttacatttaaaatctgactacaaagactctcgtatctatagctagtcaagaacaaacagactccaataaattcatcaattcatatggcactacaaagaccaaagttataaaaccttccttgattatatcattaaaataattgtgttagcaaagcttattagtaaaaaatatatgttgactaaacttattttatttttttaaattttattattattatactttaagttttagggtacatgtgcacaatgtgcaggttagttacatatgcatacatgtgccatgctggtgtgctgcacccactaactcgtcatttagcattaggtatatctcctaatgctatccctcccccctcctcccagactaaacttattttaaaataaacaggataaaaaacagcatttttcaaacactgtttaagggcattaattagatctcaaagagccttaaaaattcaatgagtttatttacctttaatagatagctacattaatatacactactttagatactttttttttttttttttttgaggcggagtctcgctctatcacccaggctaaagtgcagtggcgcaaactcggctcactgcaacctccacctcctgggttcaaccgattctcttgcctcagcctccagagtagctgggactacaggtgcatgccaccatgcccggctaattttttctatttttagtagagacggggtttcactgtgttagccaggatggtctcaatctcctgacctcatgatccgcccgcctcggcctcccaaggtgctgggattacaggcgtgagccaccgcgcccggcaactttagatacttctaatattattcaggtttttggcctaggtaaaaaagaaatgtaacaattaagattgactggcctaaagtataaaataaattacttttaattacagctttaattccacagttttgagatactttggtgtaaaataaaggtaattcttgatagttatatttaagattaagatgtaaaaaatgcaaatcatcactaaggcaggatggattaatttacatgagaaaactgtacactattaagtatacaaatggatttcaatcctatgtatctgaaaacttggacttactagaaaaaaaataaaggacaaactccctctactggtaattggagacaattcaaatggagagaatagtatttttggaatcagaattttacagacagaaactcacttcctatttgtaaatggggaaactaaaacctgaggaagactatacatcaacaaataaagtttaaagagttaaaaactataaatagaaaataattatttcaaggaaagaggaaagaaaaaactaaaggaaaacttcatttctgccagctcctattctctcccttaatttcaatcagggacacatgatatttaaaaagaaatgtaaaagactgccaaggccaggcatggtggctcatgcctgaaatcccagcactttgggatgtatcctttctgcaaaatttgtaataaccttggattatagtctgccccatccaatgaatgtctgcacaaatgctcttcttcacatagtttctaaaatagtctgtgctacaatctcttttcaaagaagatgtaagaagtcctaatttagcctcctattctgaaagtctatcatgcttgccttcctgaaacctacctgactggttacaggactctcctctattagttattaccacgaaactaataaccactatcaatcactgttactacttactctactagcagttacttcacatatatttacctacattacaggacagaaataaaaatattacaagggctgaatgaggtatttggtcaaaattcaaaaggaaaactggtaagtgatattttaggtgttgaattctaagctttcttctgatatcaacatttttataatttaaaactgcttaatagcagatgatagacttactcagaataagagacatgctttgacaaagaactgtatgacattcttcttagcattttagtatcaatattagtaactacaataacttacattcttcctaaagggcagactgactataatttctgaatctatttttatcacatgaacccttaagactctgaaaaaatattaaaggtgatataatatgaagacaattattaaaattcctttagtcttctaatatatttcctgcaaacttaccatctgtacacttttttctaattcctggggaattgcaaacgtagatgaaggagcctgagtaagaggccacgcaccagcctagaaggaaaaaaataaaataaaataagctaaatggatcaacatctaaattcaaagtaaatatttattaaataatctaagcatctaaaacatttttttcttcctcaaaatgttgatgaaatctgagtatttctatcatggcacatttcattccaaaccaataggacctttttttgttttttttttttgagatggagtctcactccatcacccaggcttcaatgcagtggcacgatctccgctcactgcaacctccgcctctggggttcaagcaattctcctgcctctgcctccccagtaactgggattacaggcacgcaccaccacacctggctaatttttgcatttttagtagagacgggttttcacatgttggccaggctggtctggaactcctgagctcaagagatctgcctgctttggcctctgaaagtgctgggattacaggcataagccaccacgcccagcccaaatcaataggactttagaagccacaatctactcacagaaccaaacgtaatcaggcatccatttatgaatcatttgtatcaacgtactgaaatgattagtaaatgctcatagtaaaacacatattcatacctgtagaacatatatttgaaaactaattcccaaatctattactgtgtcttggtttttgataaaattgttgaacttattgttgagatcagcgctgacactcatatctgtatacatccgatgtagcttgctggtaaactcataaccacaggcttgctataaaaaagttttagaaaatacatgaattcaaaagaaaaataataagtcatattggttaataataatgtgtcggtattgctaggtctttgatcaaaggttcttgcatatacacttatacccaaggactagtaatatattcttcataagtcaaagcaactaatcaaaacctttcaaactttctttttaaagacgtattttaaataagtgaataaaaaccacctatctaggaacaataaatctccccttaaacaaaaacttttttatacattcatctcttatttcagcactgcaaaatgccccgttactatacataagataccttaaaaggattttatgttgtgttttgttttaaagacttggggtctcactgttgcccatgctgcaacgcagtggctattcattggagccatcatggtgcactacaacttcgaacacctgggctcaagtgatcctcctatctcactctcccagtagctgggactattggcacatgccacagctgctggctcttataaggtttacagatagtatcaaatgaaagattacataaatgattactgggaatactccagcctgtagtcaattgaaaaagttctatttaggcatatttttaatagcatctactgagtgctgaagaaaactatttctttaaaattattcaaaattctgttgttaccaggtcagaaaatctgaatctctaatcttgaaatataaaaagctcattaacactactttttttttgtaattaatctatttagaggcaggatcttgctctgtcactcaggatggagtgcagtggtatgatcatggctcacagcagccttgatgtcccaggctccagcaatcctcccacctcagccacctgagtaactgggactagaggaacacgccaccaagcccagctaacttttgtatttttggtagagacagggttttgccatgtttcccaggctggtcttgaactactgagctcaaacaatctacatgccttggcctcccaaagtgctactattataggcatgaaccaccacacctggccaacactacttttagaaattaaaaattaagtttctttttggaggtttaaaaaagagcacacagcaactgggtgcagtggtgcacacctattgtcccagctgctcaggaggctgaggcgggaggatcgcttgagcccaggagttagagtccagcctgggcaacatagtgagaccctatctcttaaaaaaagaaaaaggaaaaaaggaatgcatattatattcaaaatgtctactatgcaagaaaatttattgaataacacaggataaatatgaacctgctaccacttatcggtatgtaagcaagctgaaatgatgtaaaaataaattgaaatggaattgcactccaaaatctgtacttaaaggaatattttaggtgtattcatttataagtagtaataatcttttatcattaatactgattatcttgtgaatcttcatatataaacatatacattttgtccttttaatacagtatttgtatatcccactgtgtgactacacaaatacacatttaaccagatgaattgtttcctgttactgtacacaatgctgcaatgaacatctttatgtgcttgtgaatgaatttctaggacaataccacattaaagacttacattacctttaatttgttgatcatggcttcttcagagtccatagacatggataacccatgaattaaacgttttgccagcattcttgcgtagaactacatttaaaaatattttaaaagattacttcctttctaatgatttagcattcagaaataaagttgaccaaaatacaaatgaaacttttctgttcacaacataccttttgaaagacgtccttgtcatcaatgtatttgaacactgtgatgaagctcgtgagcctgtcttccacttcattctctgtcatccctttcgctgacttcttcagtaagttgtcacagtacttagcaagctcatgtagaaattgataataaatcttacaaagggtgcttctgtatatatcacgcctcaaaggaggcaaagtggtgatacaaggtaagatcagcggacagaatttttgctgttttttttagagaccgggtcttgctctgttgccaggctggattgcagtggacaagatcatagctcactgcagcctcaaactcctaggctcaaaggatcctcctgcctcagcctcccaagtagttgggactacaggcatgcacaaccacaccaggcttctaaagctttatgtaataatcataaatgtaaactaaataaaatatacatcataaggtaaatttttaaaaagaacaagtcaaatatcaaatcatcacttattgaccaataaagcaactgatataagtaatacaaatttttaaaagaacacctaggtgagtttcgagtggttttataatttttgacattgaacaagtactttaaaaaaaagttacaaaaatcttgtaagcaagtttccttcaaaggttacccaaactttatcatcagatttcctttagatttcagatgtaacagaatctacatgaaaagtattgcaaattatttcaaagtagatatacattaaaacccaaactttgtaaaatggttattctttaagacacatagtatattgcattccttacataaatgccaaactatatacaatgtagataattttccttctatttttctgaaaaatgctacaaaaaccaaattaatttgatattctgagttctcattttctaatactgacttttcataagattacttttcagcaaccaccaaacttaccagttcaggtgctttgcaaacagacttaggttctctgtaatttacaactgacgtaagggcctgaataaaaaaacacgccataattaaccaccagccatagggaaaaagtacagctagttcaatataagccataatctgtacatccaaaaattaccccgccacataaaacacagcattgccggtagtttgttaatattttcatgcctaacatggtagactcctctgactttattctctaattacaaaatatctatatatcctgttgctattccaagatattctgtaactcattatcgaaatttgaacagataaaataacgttacttaaaaaaaaacttacaatcttgtaagcagctttcctttaacgtatgcaaaagttcatgtaaaacatatctattctcttttcaaatattattcaatatagcctaagtattatggccaaagaaaaaaaatcagtactaaaaattgcaaaattatgcatgtctatccagaacatatcagattaaaaattccccttatatagcataatcacgggacattctacaagcattcaatttaactattcagttaataatttaaaaattatattatttctattttgaatttcatatcaaaattacttaatctccatgtctacatcagaaacctcatactagaattctgatcttgaaactgcctaaagaatgatagagttttatgtacatatatagtatatatgtatttaaaacttaccttatccaacgcactcataaaatgctgatcaccattcaaaacagtgttgataagctgaacaaatttaccatgcacttccaaaactgactccacaaatagtgttggcatctaaaaatgaaatataagtacaaaaccacattttaagaggttcaaggatatccaaactatgaggtttattagacttattagtaaatttttcctcaaggaaattatgtttcacacatgcacacttctcagaaaatggttttagctaagacggtcttagaaatttacaactttggtgttgaaggctgggcacagtggctcacacctgtaatcccagcacttctgggaggctgaggcgggcggatcatgaggtcaggagatcgagaccatcctggccaacacggtgaaaccccgtctctactaaaaatacaaaaaaattagccagacgtggtggcgtccacctgtaatcccagctacacgggaggctgaggcaggggaactgctggaaccagggaggtggaggttgcagtgagcagagatcgcaccactgcactccagcttgggcgacagagtgagactccgtctcagaaaaacaacaacaacaacaaaaaaaaaaaaaaaggaagaaagaaaatagcttgtcattcaacacaacaagctgtcatagactgtctagtacctgtcagaagaacccaccaaaagcatacttttctactgtgttggaataacttatcttaaggataacaagacctgaactaccaggtctatcactttcatagaggcttaaataagcaaagactgcctgcaaagtcactaaaggctgagagaaaggagagttaaaaagccaataatcctgagaacagagaccccttgaactcggcaagacaatccctcacatctcagagagaagaaatacctaatagtacaaaagtgagttttccctcttaatggagataaccatgaagaagttactacctaagacttaactaagtcagttggatttgagtctaccacaaatgtattcacttatgtttccatctcccagccttgacacaaaattcgatgcttctatgcccaatgtcattggacatggaatctataaacgtaataatgtaaactagtaagtttgacaaataatagagtaataaacctgaatactataaactaatagttctacaaaaaatagaaaactgtggtaaagggaatttgaagaaataaaaaaatagaaaacttacacattattgtggcataacataaaaactaaaaattattacttgccaaaaaccaatctgcagctaaggtaacagcctctaaaaagtgctcctgaacagtgacgtctatacacagatactatcttatagatgaagggcaaacagctctacttaagaagagacagtaacatttgaagttatttctctcttgctcatcaaacattaccagtaataacaagatttggtgatgggaaagacaaactgttacagtacaaactgttacagtcatgtgattggcaaagtattcgagaaagatgagtattagggatatgagggttattgttttgggtatttggggcagcaagcatatacttacagaagattattttaatctaaatttgcttcctggacaaccaaattcagaggatatggaaaggaggcaaattgcaagtcgtctatattaccactgattaatactactaccatgacaacaaactacgttatcaatgccaattacacaaaaacacagttatttaaaaatggcgagcttattttcctgtggaaagttaacaactgttcaatggacaccctccgtatggctaagcagcagcctatcaatagctttctaataatctgataattccaaaatgagtccaacaaattctaggtttaaaacatttgaataaagacatttctttcgttggcatggtaagactttttctttcatctttcaaaacaataaagtcaaaggaaaggctccacgctggatctgattaggaggaaaacattgcagtttcccacacaactcacgttttcctgagtaaggttgctggttgctcgaaggccctcatcatggatgtggttttgcagctcctgaatcatatgaggtaaaccagtggacacagcacggagtaagacgtacatatttgccatgtctgagaggaaaaagacatctgagggttaactcccaaatattttcatttattaggtaatatatggatccaagtgcaggagtacaatatacggatccaagtgcagagcacccagagaaaagtcccccatgcccacctcccagccacccaagcccctctccccacaggaaagggatgtggttatttaacatcttcccaaagatattttgtgcaaattcaagtgaatacatatattcttccctttgccccttttaatacagtgtactgtattttgtatattatttgtagcttcagaacacattttaacttagtggtcttttcctatcagtacacaaagcatttctatgtattttacagctgcacagtactccattatgtggatataatttcttaacaactgatggaaatttaggtggtttccagtctcttgatattgcaatgttgcaatcaataatcttatacatgagcaagaatatatgcaatataagttcccaaaagtgaggttactgtgtcaaagtttaatcttgtagacagatccttctaaccacagctgccaacagcagagagttcctttgccaacaatgtgttgccaaatgttttgatctctaacactgggaggtgaataatgatctctcagtgtagtaggtttaattttaaacgtttcattaaagcatcatacatatacagaaaagtatacaaaccataagtgtatatcttactgaattatcacaagtgaacacacaacacacccatgtaatcacacgcaggataagaaacaggcattacctacacccaggagtccccttcatgcctccttccaatcacacactcttgctcctctgcaaaggtaaccactgctgtgacttctaaatcacagatgagtttgaactacgtataaaaatgggatcacacaattctttcgtgtctggcttcttgtgttcaacatgtgtataaggatcatctatgttgttgtgcatggctttaatttgttcatttccactcctctataatattccattgtatgaatatactgtactattctacagtaactggacatttgagctgttccagtttatggagctattacaaacactactatgaacattcctgtatgtctttttgtatatatgtccaggcattggcagtggggaggtaaagctggggggtggttatatgtttaggagaactgctggatcataaaatatgcataatatatcccacttagcggtcagtgccagtttcccaaagtagttgcatcaatttatactctcacttcagtgttcaacaagttcctgctacttcacacttctttctatgtttattggccatctgggtatcttctattctgcagtgcctgttttttgagcattttatattttggatataaatctttagtattgcaggtacattaccctataactgtcttctgatgatccagtggttttaatggctttttttgagacagggtcttactctgtcacccaggctggagtgcagtggcaggatctcggctcactgcaaccaccacctcccagattcaagtgatcctcccacctcagcctcccaagtagatgggaccacaggtgcacaccaccccgcctggctaatgcttgtatttttttgcagagatgggatactgtcatgttgcccaggctggtcttgtactcctgagctcaagcaatcttcctccctcttaatggccttttaataatccaaagtttttcattttaatgtagttcactggatcaatcgttcctttgtggttagggctttttgtgtcctatttaaaatatctttccctgtctcaaggttatgaagatattcttctatattatcttctagaagtgttatttttttaccttgtacatttagagaaaaaactcaatagtgaattgattttgtatatggtatcttgaggtagtgatcaaatttcattttcttctgaaatggatatccaattgactgagcaatgcgtgttgaaaagaccatcttttacctgccgctctgcagcgccaccttggtcttacatcaagtggccacatatgcttgggttgtttctaggatctcttattttattaggatatctgtctgtccttgtaccaatgcctcactgtcttaattactataggttttacaataagtcttgctggtcattaaagtctttccatcatactcttcaagacagtgactttcggaattaaaatgaaattattgggttttgactacattgccctggatctatgaaattaatgttgctgtaaaaaacacggggccaagggtggtggctcgtgtctataatcccagcactttgggaggccaaggcaggtggatcacgagctcaggagttcgagaccagccggccaacatagtgaaacctcgtctctactaaaaatacaaaaattagccaggtgtgggggcggatgcctgtagtcccagctactcaggaggctgaggcaggagaatcgcttgaacccaggaggcagaggttatagtgaacagagatcgcgccactgcattatagcctgggccacagagcgggactccgtctcaaaaaacaaaaacaaaaagcctgattaatggccgggcgcggtgactcacacctgtaatcccagcacttcgggaggccggggcaagcagattatctgaggtcaggagctcaagaccaggaggccaacatggtgacaccccgtctctactaaaaatacaaaaattagctggatgtgatggcacacacctgcaatcccagctacttgggaggctgaggcagaattgcttgaacctgggaggcaggggttgcaatgagccaagatcatgccattgcactccagcctgggcgacggagcgagactccatctcaaaaaaattaattaattaaataaaatatacatatttattatctttcctgcctataaaagtaatgcatgttttttgtttttttaaaaatcagagaggccgggcgcagtggctcacgcctgtaatcccagcactttgggaggctgaggcgggcggaccacaaggtcaggagtccgagaccagcctgaccaacatggtgaaaccctgtctctactaaaagtacaaaaaaattagccaggtgtggtgatgagcgcctgtaatcccagctactcaggagtctgaggcaggagaatcacttgaatctgggaggcggaggttgcagcgagccaagagcacgccgctgcactccagcctgggcgacagagtgagactctgtctcaaaaaaaaaaaaaaaaaaaaaaaaatcagatatagctgattttttatattatataaattattacatttattacataatatttgtatttcctttttatagtctttgcctttattcctactgtttatcaggaattctaaatgcattaaggaaattagctcttgtaatatataaaaatgtataaacacaatttcccactttttcttctgattttagaacactctgaaaacactttcctaaaatagtctttcaaaataaagtattaataatctgtaaaaggttatttaaaatattttaaagactattactaaaataggcattaaatcaagggtgactagaggatgatataaaaggtggatttataatttaatttctactcatgtttggtgtcacttaccattttttttctcttgtcgaattatattatgacattctgcatgtaaaaactgtaagtggtctgctaccattcgttgttgacattcatgaatcaccttagtatatgaacttggatgtaggtattttcgacatcgaatttcttcatcttttaatctacctagaacctataaaaatattttcttacagtcatgaacacaaagttttactatgaggaaaaatctgtaatatcagcaagtaactcagccaaattttaatggctgaattaaacatggcaaaggtaataagggttacataagcaatttaaacccacattctataaatcatttcaaatttttatttaagctactagctgtcatctacattccaccagtcttataagcaagaactaaagttaaatagtctgcattttgtcttcatttacctacaccattcatcctattacatggacaacataacatgtaacaggaaaagtgggtacagatgattaaattcagaacaggtgatctctgttatgaataactatcaaactaaaaaataaattatattgaaatcaagtagatgaatctaattattttacgttggtttctcttcttgtaaatggaactgtatgtgcatgatagttaactaccatattaaagatttaattaaaatttttgaaagtaggggctggacatggtggctcacacctgtaatcccagtactttgggaggccaaggcaggtggatcatctgaggtcaggagtttgagaccagcatggccaatatggcgaaaccctgtctctactaaaaatataaaaattagccgggcatgcctgtaatcccagctccttgggaggccagggcaagagaatcacttcatcccgggaggtgggggttgtaacgagccaagatcgcaccactgcactccagcctgtgtgacagagtgagacactgtctcaaaaaaataaaaataaggccaggcaaggtggctcatgcctgcaatcccagcactttgggaggccgaggtgggtggatcacatgaggtcaggagtttgagaccagcctggccaacatggtgaaaccccgtctctacaaaaatacaaaaaattagccaggtgtggtggcaggtgcctgtagcaccagctactcgggaggctgaggcagaagaactgcttgaacccaggaggaggaggttgcagtgagccgacatcacgccactgcactctagcctaggcaataagagcgaggctctgtctcaaaaaataaatataaataaaaaataaaaaatttgaaagtaaatataatttagtcatagtcaagtatgtcaatcaagacttttattaaagtttatcctacataaagcgctgagctacaaataacactggttaatatcaacaagaactagcccataaggaaaataaccaaagaatttgactaatttctgtctcaagacaaaacaacaacatatacacagacaaatgcaccggcttggaaacactctggaacataaagctgtgtaattagagtttctgaaattaagtgttcccggggaactacatacacctggcactttggagagtgctgctgagttggcctgggcacaaggagtgaaaatcattcctggaaagcggatcagaaattttcaataaaaatgaggctccagacagtaggttcccacagtcctgtctttcctattgtgcgaccctttgaagccaggagttcagggcaaagtcacagactcaggtcgggcaagaaggggtctagagcagcagtccctaaccttttaggcaccaggctctgcttttgtggaagacaatttttccacagacggagtgcgggcggcattggtgggggcaggtggcttccaggtgaagtattccacctcagatcctcaggcattagattcttctaaagagcgcacatcctagaccccttgcatgcagagttcacaatggagtttgcgctctgtgagaatctatgagaatctaatgctgctgctgatgtgacaggaggcggagctcaggcagtaggtaatgctcacacagtggctgctcactccctgctgtgcagcccggttcctcctaacaggccacaggtcagtactggtcctccccagttcctaacaggccacaggtcagtactggtcctcagcctgagggtcagggacccctggtctagaggacaaaagtgttcaccacatattacatcagctaagaaaggcactttgattaacaataaatcctttaagggctatttttataacaaaaaggattaagtctattagtcattcagagcatactatagtgactttaatctgcttgccaagttaatgcaacaggaattacagtgggtctgagagaggtgaaggaggatggaagaaggaaaaaataaaacaatgataacttgggagagagaggcgcatatcaagagaaatgtagagaaggttggactgccccagtgcagggcttcaaacagctgtaaaacccctgggggaaagaaaggccaaagctataagaggaacgcagcaaggaggcaggaaggctgtactgactcattccccaattaactaaatggagagcaaagcccagggttttgcccttgaagctaatatggtccaacattatttcctgaaatgagcttttctttttctttcttttgtcagacaggatctcgctctctggcccaggcaggagggcagtggtgcaatctcggctcactgcaacttccgcctctcaggctcaagtgatcttcccacctcagcgtcccaagagctatgaccagacgactacaccaccatgtgtggctagttttttaattttttgtagagatggggttttgccacgttgcccaggcttgtcctgaactcctggacttgcgtaatctgcccgcctcagcctcccaaagtgctgcaattacaggtctgagccaccgtgcccagcctgaaataagcttttctaataaacattcttttccaaacataatttattccaatgtccctccttcccttttaacaccttgagatgtaatttacatattaaataattcacccatttaaagtgtgcaattcaatggttttggtatattacattatcaatgtttttaaattgtggtaaaaacatagataataaaatttacattagccatttttatgtgggcaattcagtggcattaaataacgctcactatgttgtgtaatcacccccattgtctacttccaaatatttttcattaccccatcagaaactttataaccattaagtaacaactcctcacatcctcctcccctgataacctctaatctatcttctgtccttttgaatttgtctgttctagatatttcctataaattgaaccacagaatatttgcccttttgtgtctgtctttttccacttagcataacattttcatggttcatccatgttgtatcatgtataacttcaattctttttaaagactgtgtggtgttgtgatatgtaagtacattggttttcatctgtggttcctggttcataactcccttagccctagttacagtctttagttataatgttgagtgtgttaggtctcaggaaacagaatttctctcctactctcctttcacctgcctcaaggcaggactctaatcttgccctacctttctgactgtgggtcataagaccctccccagagaaagccccaccctgtacgctgggggaaagactactgacatcatgaagcttccacaaaaatccaagaagactgggttccacagggatagaagctcctgcactcatggtgatttcagaccttcccttatgtgtctcctcaagtggttgtttatttgtatcctctaaaatatccttcttaatgaactagtaaacattaagtgagtgtttccctaagttctgtgagctgctctagcaaattaatggaacccaaacagtgtactgtaggacttcaacttgaaagccagtcggtcagtagtccggaggcccagacttgtgactggtgtctgggggtgtgcagggcagtcttggagactcagtccccaaactgtgggattagccactatctcaagtagatggtgttagagttgaactggaggacacctagctggtgtctgctgcttggtgtgtgggagaagagagccacacctttgtttacagaagccttctgtgctgatgattgttgctgtggtgtgagagtagaggaaaaacatggtttgagagagtttttcactacacacgatgaataatattccaatgcacatatgtatcacattttgcttattctttcaacttctaacagacatctgggctactgccaccacttgccagtggcatatttttgacagccagacagagcaaagtgcatgtatcacagataatctgtgtgtgattcttggggctggatctagaggcttcaacaaaagtctaaggtgcaataagggctaagagcttagaaccactgatctagtgtaacctgaacttaattgatgggggaaaagttccagataatttgctcaggggacagagctaactagtaagaaaagcaggaagataatcaaacaactaagacctctagatctgggctttgtggatgacacaacagtgtatcggtaagcacggatgctttgtgacttgtggcctagggatgtaggatgacagctcacccacttaaactactcgacctttcttggctacataaactaacacaaaccatcccaaaataaaatgcttgaaatccaacactgcagatttaaaaacctggctagaagttctaatatatcttacatatggtggtttaatttgtatgaacacttttttcttctactactgagaaaataaacatgggatttaacatatgataaccaatatgtactggtttagtgatcaattaaaatttcttggctgggtgcaatggctcacatctaaaatcccagcgctttgggaggctgaggcaggaggactgctcaagttgaggagttctgagaccagcctgggcaacacagcaagaccccatctctataacaaattttaaaagttgctgggcgtggtggtgtgtgcctgtagtcccagctacttcgtaggctgagacaggaggaccacttgagcctgggagccatgatcaagccactgcactctagtctgggcaccagagcaagaccacatctccaaaaaaaaaaaaaaaaaaaaaaaacacctcacgtggggttgtctctcagcctttcaagaacttaacagaccaaaagagtgactcatccaaatgtctagaattactatattttcctcatatttttcctctcattttaaaggaagaaaaaaacctcaacacagagcttctgcacttatcctattctctaaactaaccactaagcatgaaatccagtataaactgattattctgccaagaatgtgcatatatattaatttcaaggacaagtaaaccaagcagtcaggatttatcaaaaagcatcaattatgatgaaaactggaagggtattgtaaagagcaatgacttatcaatcgatattatataataactgtaactcagagttaatgattaaatagattaaataaacagaatatttttccaccaagaaacaaaacaagaaaactaagaacgatgttaaataaaaccaggccagatacaaaatagataaatgtattcgatatgttttatttcttaccttttccatatactgtgagcagtttgattcttgtaataaatttgaagcttcttgtttgtaatactctcctgtttcagtcagaaagggagactcaaaaatttcctgataaaactgaataaatcaattacatcatattagaagaaattagaacaagcagtttaagaaattaacagtctgattatttgtttttaaaggaggctgtttacctttaaggggaattttttcttatactgttcaacatgaacaaaggagttaataaccccatggattactttctggtttgggtcttctccaccacgatcactaaaacaaggtataacacaaaatattcttgagaatacaaattatctatggaaatatacccaaaatatgccaaaatatggctccttattctattggtctaatcaaagtgtaaagaactataaaaaggtacatgcatgaatcttaacaatgattttttttatatcacagctgagttaatattcatgatagttaatgtatacattagatgtcatttcaagaaataaaaagaaaactgattgtaaagttcaagatactatgtcagtaataagataacacttctttaattttaacaaagtagatacgagcccatcaattcaaaactttaatactggcggttaagaatgcttgattttcactcactacaaactacaaagtcttaatcatattaagacatgtaggtgaaatgttagcttttctaataaaaggaatatgaaatagaaccaggcaccgtggctcgtgcctgtaatcccaacactttgggaggccaaggtgggaggatccctgagtgctgaatttgtgagctgcctgggcaatagagcgagacctcattcaaaaaaaaaattagccatgcatggtggcacacacctgtggtcccagctactctggaggctgaggtgggatgatcccttgagtcctgagtttgagactagcctgggcaacatagcaagaccccatacaaaaaaaaaaaaaaaacaacttagctgtgcatggtggcacatgcttgtggtcccagctactctggaggctgaggtgggaggatcgtttgagcccaggaggagtcgaggctacagtgagccacgattgcaccactgcactccagcctgggtgacagagcaagaccctgtctcaaaaattaaaaaataaaaataaaaataaaatagaaaaaaagtttgcttaaagccacagtaaaataatctagctctaaattgggattttgtgactctagtaccaatgctcaaatcaaaccattatggtttacctcactacacactcttccaacctactttaaaataatttcttctttgcattaataatgtcacaaagagagcaacagaaaacttattatcatcattccctagtaagagcttgttgctctatatataggatgtaagaattttctatcattgaagaaaagcatcaaggaaaagcatccaggcaattacctttacatactagagtccttccctgcctctgaacccctctagtcctctttgattcttcctttaattatttggatattctgagaactattttttggacatgaattaatatggctacagtaattctgtcagtcatagagaatcttgatatcttgatatcactgactagttcatataataaggtcacacatgtgagctcatttccttggcttgggtcacatgcgtgacctcacataagcccacattcaatctggtgagatactgatctgaactgttacctattttctcatgttctgcttatggtggaagaacagatactgtggaggacatactggcaaaactctaagtatacacaccctatgaccccaagcaaacatctacatatgtgtacaacagaaacaagagtggtgttagtggaaaaactggaaggaacctaatatacgccactaggagaagagtttaataaagtgaggtaggcctctctagtttaagtctgagttcatcctggtaaagtttaaaaagctaactggtcacctaaggatgacagcaaaccaactcattatcttaaaaactgggttattggccaggcgcagtggctcacactggtaatcccagcactttaggaggctgaggtgggcagatcatctgaggtcgggagttagagagcagcctggccaacatggtgaaatccagtctctactaaaaatacaaaaattagctgggcatggtggcgcatgtctataatcccagctgctcaggaggctgaggtaggaaaattggcttgaacctgggaggaggaggttacagtgagccaagatcgtgccacggcattctagcctgggcaacagagtgagactctgtctcaaaacaaaacaaaacaaaacaaaacaaaacaaaacaaaaacaaaaaactgggttattaaaaaggaaagaaacaaacagttattttgcttttcctatatgaactctaccattgggtaactaaacagtaggtgagaagaagcatatcttgataaaattttccaggtaataaagaagaacaaaatgatagatggctctaacaagcagctctataatatgctgactaaattactaatttcttcatttcctttaactgacattcccacctagaaaacaattttaaatatcaggaattctattcactgtaaaagaaagatgtggctcacatcagaaaccctacctcaacctccatatttgcttaattctctatgatagttcctcaattctgtgagtgaacacattagattacaataaaaaataatttggttaaagatttctgggccaggcgcagtggctcacgcctgtaatcccagcactttggaaggccgaggcgggtggatcacgaggtcaggagatagagaccatcctggctaaaacggtgaaaccccgtctccactaaaaaaaaaaaaaaatagccgggtgtggtggtgcgcgtctgtagtcccagctactcgggaggctgaggcagaagaatcgcttgaacccagcaggcagaagttgcaatgagctaagatcgtgcaattgcactccaacctgggcaacagagcaagactgtctcaaaaaaaaaaaaaaaatacaggcataaaggccgggtgcggtggctcactcctgtaatccccacacttttggaggccgagaaagttggatctcttgaggtaggagctcgagaccaacctggccaacatggtgaaaaccggtctctactaaaaatacaaaaattagcagggcgtggtggtgcccagctactcgggaggctgaggcaggagaattgcttgaacccaggaggcggaggctgcagtgagctgaaatcatgtcaccgcactccagcctagtagacagagtgggaatcctgtctcaaaaaaaaaaaggaaaaaaggacaggcataatgaattcagagttagattagcccagatgtgaatccctagaattattattagatggaggctggagtcaaatgatctgagtcagatcaccaccattgacttttgcatgtcaaggatgtcatgcatgtaaaatggtgacactaatagtattagccttccagtgttgtgaggattaaatgggaagatggatgtaaaatttttagcacaatgcttggtatgtagttcccatgtttaatttctattattaatatgccttagtttccttaactttaacatgcaaaactctaagagagctgtcatgaagaataagtgagatcttagtaaagcatgtgaaacaatgctttaatggaagccgattataacaacaaaaataagacaagcagaccagataatctatcttttccagaactaatatgctttagttgtattatttttcttacattgtttccttcattttttatcatattgatttttagcaaactaacaatcacactaaaaatttactaggttgggacaaaattatattaaaaaagatatttcacaaaagtacatttagaaagtataacagtattgtcattatacttttaaatacttgaattccaagtcaaaagaaaagttagtatattttagcaggagaaattatattagaacttagaagttttgttgggagtgttcttttagttcacagttttgtaaagaaaagaggaagaaaaacaacgggttacaccctactgcttcagtattgcctttcctctccagctctctatctctaaaaacaatggaatcactcaaacggtcagtgacaatttttaaaaatcaagttactagttgttaccacctactttctattgggtatcaaaaatttaaaaatattctcttatcttcttatgtgaggcataggggtgggtgtgtgtgtttaatcccttacttcctcccaggagtcccatactaaataccacggctttgacaaagtattcctcatataaaaaaaactccttatttaggtcttcttgatgagcacagatataggtggagtggccattattacactacaattcactggtctagataattcctataacatcagttccagtaacctggaatttactggatatatatttgtgtgactgacagagtgcttctgagagtctttgagccagagctaatccaaggatgttctattctagactccacaggaaaatgttctttgtactaaattgtattcacacagcactagggtaaaaagtgttaaccactctgagccatgggtagagtgggaaaccattttcccataaatttatctcacagaattaggcaagttattgattataacactgaggctaagaggtagccaactaactagaagaatgtcttcctcaataggtggtcctcacgaggatttaaacaggtaatatgtacaagcaactcagggcactgcctagaaagtctaagagttttcagctctgaaaagcaataagtcacttccctcagatacttatttatatactaagcatattagggtataagaaaagaccagagctccccccaccaaaaagaaaaaaaaagaaagaagaagaagaagaagaaaataaaacaacttaaaaaatgctggcattggaagtaaaatgaggctcattacagtaaaaccagccccaaggctagtcactggctctgcaattgtacactattttaaaaccatatcaaacaacaaaataaaattgactcagtaagataaatgtcagcactcactttttgatttctcggagcagcattcggataaggatggcctgaagtggttcaaccatcaatttcctccacatatccaatgctagctgccgggaaaaacgaaaatcatcagggctgaattacttagtatatgtttaacatttcctcaaggttttttttaactaaaaatactcatcaaaagaagtatttatactaatacttcaaaattcaaataaaacctgaacaaaaatttaaaaactcaaagaaaacaaatttctaatttgaaatatcagtgaccactctactagccttatcaacattaaggttttattattagttgaaaatcttaagaaataattgattattataaaaccttaatttaggccaggtacagtgggtaacgtctgtaatcccagcactttgggaggccaaggtgggcacatcacgaggtcaggagatcaagaccatcctggctaacatggcaaaaccctgtctctactaaaaatacaaaaatgagcctggtgtggtggcatgcgcctgtaatcccagctactcgggaggctgaggcaggagaattgcttgaacctgggaggtggaggttgcagtgagcccagatcgtgccactgcactccagcctggtgacaacagtgcgagactccgtctcaaaaaaaaaaaaaaaacttaattttttgattgttaaaatgctcaacactataaatgggctatagatacctagaccgtaacagaaacaaaggatttatgttaaatgaaataatgtgatttggctgtagactgatttttttaattatgaaaaattttataccaacataaaaagagcaagtcggttaaaagagtaataaaacattcctgtattcactacccagtttaagaaatacaacttcatcattaccattgtcccagatatcctcctcctttcccctcaggttattacaatccacaattttgtgaaacccatccagtggaaacatacagccatagctcaatcattggcactgctatacagcatcctgttgcataaatatgccatgatttatttttccactctactgctgatgactgctgatgtgtctgtgattcctattttctgctactggaaacaatgctgtgattcctgtatgcatcatttggcccacataagcaacagattctctgatatacatctacaagttgagatcctgtactgaacaatcaagtgctcatgcagctttactaaatcaagccaaatgattttccaatttatacttgcatagcaaagcacaagatttcccattagtccccatccttgacaacaagtggtactgccaggctttagtcaaattttgccagtctgctggacataaaatagtgtctccttggccaggcacagtggctcacgcctgtaatcccagcactttgggaggctgagacgggcggatcacgaggtcaggagattgaaaccatcctggctaacagggtgaaaccccatctctactaaaaatacaaaaaattagcggggcgtggtggcgggtgcctatagtcccagctatgcgggaggctgaggcaggagaacggtgtgaacccgggaggcggagcttgcagtgagccgagatcgcgccactgcactcccgcccaggtgacagagcgagactccgtctcaaaaaagaaaaaaaaccggccaggcgcggtggctcacgcctgtaatcccagcactttgggaggccgaggcgggcggatcacaaggtcaggagatggagaccatcctggctaacatagtgaaatcccgtctctactaaaaatacaaaaaattagccgggcgaggtggcgggcgcctgtagtcccagctactcgggaggctgaggcaggagaatggcgtgaaccggccgggcggagcctgcagtgagccgagatcgtgccactgcactccagcctgggcgacagcaagactccgtctcaaaacaacaacaacaacaacaaaaaatagtgtctccttgtggttttaactctcattttactgaatgaagctgggaattctttaatgtttattgtccattttgggttcttccctgtgaaacgcccattcctaattttgcccgttagtctgttaaagtttgtcttgttcttaataaaagctagagttttttatatattgtggaaattaatcccttgaaagtttcacagtctgtcccagtaaatcaactgctcggtttctttattgtgttttggtaaaaatatattaaagtttaatatactcaaatttaccaatcttctttatcatgggtattttttaagaaatccttctctgccctaaggtaataggcatatgtgtggtcctactctgccttccaagttttcaagctttgcctttcacatttaggcctttaaacttcaaatatattttccccacatagagtataaattattccagtactgaaaaccaattttttgtttgtttgactcttctctttttccaccctaactacatccagataggctgttgctagcctccctattgtttccctagggtaattttattctgatccattggtaattaagcatctgtcttcccacaaggaacactgttcaagttttgcctttctttcttaatagcatgaatgggggttggggaggcaatacatgaaaaactggtattttacacatgtggtggaagggcaaactggtaaaggcccttctgaaaggcaatggggcagagctgcgaaacttcaggatgtgcttcgacagaggctccacttcctgacacccagtctataaaaagttctgctcatgtaccaagagatacacataaatataactccatgagcataagatttttctctattttgttcactgttgtattcaacatatataacacagacgggttcaaaaatacttaatgaatgaataaatgaatagtggtgttcactgcagtgttgtttgtaataacaaaaaattaaaaattggggggcgcggtggctcatacctgtaatcccagcactttgagaagcggaggcaggcggatcacaaggtcaggagatcgagaccatcctggctaacacggtgaaaccccgcctctactaaatatacaaaaaattagccgggtgtggtggcaggcgcctgtagtcccagctacttgggaggctgaggcaggagactagtgtgaacctgggaggcagagcttgcagtgagccaagatcacaccactgcactccagcctgggtgacacagcgagactccgtctcaaaaaaaaaaaagaaaaaaaaaaattaaagggatagtttaaaaaattattctgtatctctacagaatattaagctttcacaaaaaacaaacttatgtaaaaagacagacagtaacaaataacaaaaaaaaaggcaagaaatataggctgtagaactttatgtgtgccgttttatcgcagtttgaaaaataaaatcaaaactgctgtgtgtgtgtgtgtttatgtaaatatttataaatacacaggtaaagttcagaaaagatgcgaactaaattgtttacagtgattttctgggaagagaagtgtgcttgacagtgctggtgataagggaatgatttattcacttacaatgctactaactaaaagcaactactgttaatattttggtatttctcattgatctttttctctatatcatcttttccctataattgtatttgtattcaacatatacctataattttgtgtccaaattttttcataaacaatgtcccctttgttaaagtttctatgaacaattttctgctattaatttatccatttgcctacttttataacaaaatcatatcatatataatacattcttcttccatgctttttattgctgaatgttggatgctgaaattttacactgttcagccattaggcaccctattaacaatgattgcaaagaatacttttaaacattaaactcttttctaatatttattattttccaagtatggatcactaggcttaggacttgggattacttggtcaaaaggtattaagtattttaaactgtactgaaagaaagacactgatcaatttctttcggaaaggattacactaccttaaatgtctcctaatgctgcctcttagcctgtttatttccttcattaacataaatcacaagttaacattaatttcctatttggcatctgcttcccttacatgaacttacaagcttttgtgtgcagggaccttctgtctgttcaccattgtatccccaatgcctggctactcaataaagatgtattaaatgaataaacaagcttgtacaataatacttctttcacaatcagcataattttccatattttaatttgcactgtacctcaagaacttgaatggaccaaactgcccatttaattgtttcactctgaatttaattacttttaaagtaaagttacaataaatttgttgtatccataaatttgtgtttcctctcctctagcctgtcttttaagtacttgtcccctgcactttttaactacagggccgtcaacactttataattgtttctgagttttttcacaatgcagaaccattaactctatcattcatccattataaatttaattatcaaaagagtagttgtcacatctttttcgttcctgaggattcttaggaaatcactatagcattttatttaggatcttttaaatcttgaccattttaagctagccaaatcagtgtccttaaaaaatgatgtgcaatcaaattacctcagtgtataaaaacatacttatgtttgctagtcacttaaagaatgtcctacctctcctatttccataagtggttcattcatatctacaccaccatagccatactgaaggtccgcttctgttaatttattctttttaataaactgggtgttgagatacctggaaaataaatgtaatatcaatggatattaagttaaagtcagtaggaaagcaaatgacttgcaactttagaagaatatttttaagattacatataagccatggaatagcctactaacaaatccaaaagaaatgaattatgtagagattagaaatataataaaaattaaaattatcagcccacctttctctgcaagcccttacaatacccttctagcccaacagctcttatccaagtttcagaatttctataatctcgtttgctacttcccagactcttcttgggaaagtcaagataaagtccactttccaaaaattaaacagagaatggttaaaagataaaagtcaagttagctttctaatttatattctaatcaccaggaagaaatgcaatttttcatttttaaacaaaaaagatcacaatcagtaggtaagaaaatggaacacagtgttacagatagtaagtatgggcaagattgacagatacaagatgactttgtctaccagaggaaaatgaattatactaaaaatgtttaatatatttcaagactaatatatgtgattaactcagaataactgagatgaatacagaaatctaaaataaaataaaacatggagaaaggactcgtaatgttcaactgtgtagtttttaggattccagatttcactataatgcctttaaacagtcaccacctaaaactattcatttgaaaggttctgctagtgtaaatagctactgacaatacaagtattttaggcaacaacccatgaaatctatacatgaatatatacacttttcaaaattcactacaccaaaatgaagggtccactcagcatttacagacaaattaaaaacgaagacaaccaaaacaagacaacaattttgggaaacaattaaacacataattcctggccaggcgtcggggctcacgcctgtaatcccagtgctttgggaggctgaggcgggaggatcacttgaggccagcagtttgagagcagcctgggtaacagcgagactgtctcttaaggaaataataataataactcctagaaaattgactccaaagtggtatacccacaaccatttacacaagctccatctccatattcactagtcaaggctctagactccatggcttacaaccttgatgtaccatttgatattttagtgtcctctgaccataagttacaagatcatactcttttttttcccctttaaaatgccatttattccttcctctctatcctcactgtaactctcaaaatttcatgctgagtttccaaccatgccttccagctaaggaaagaggaataagattgagagacaaaagtaaaaggtaaagaggggatggcctctccacctaagtgccccatcccagatattctgagggtagtcagtcccctttcatccgagtctcagcacagacacacctttcaggtgtgccctgaaccccagaggagttagccttcacttcccagccctaagcaagtaactatttaacgcacaactgttttactttcttcacagtaattgctactatatgaaataatcctatgcttttattggtttctttttttgtgcattcatcttctctctagaatgtacagtatacaaagcaagaacctcctcttgtagacagcatccacagtagtggcaggcaaaagtcaagtcctcaaaaaataattactgaataaataaatggataacattccagacagcaaggatagcaaaagctaacagtagaacacaaacctggaaaagcagcctgcagccagatcataaaagccatgaataccaggaaataaaagtaatcactaacatttattgagatcacctgtcagacacagccctaagcattttatgtggctgaatactataagacagatgtatgtggtactcctatgatcattttatacataagaaagctgcagcctagagaggttaaagagcttgccaaaggtcaatcggctcctaagtggcagggctggcacagaaactcaggagaggtcttccactcccattcaacatcggctgagggtatatcgtgtgccaggtcaacatgaggcactggaaacacaaagatgaaaagcaaaaatatggtctctgcccacacagagctcactctgtggtacaatatacaaacaaatataagatttcgtcaggagcggtgctccctcagtagagggtacttaattgtcatattaccatttacatatgccttccaatacggaatctgctccaaaccagttttcttttctggtcactggcaccaagaccattccagtaacctcgcctaaaacatcagaatcacttatctcatccttccattttgcctgctttaatcagtcagtcttcctgtcttcctaaagtatgcatcacttcctctcactacttcctttgacttccaatctacttgctgaccctctgccccgattatgtggaacacttttatgactgggctctacttcagtttctggcatctttaattcatctaaaaattctgctgtcaggatgttactttcctattcagaattctacaggagcttcctttacctacataataagtgtaaactgcctagcatagaagcagatgctaaatctgcagatcaggcctgcattcactaatccattccaaagatctagatgtatattcttgagccaggtattgatttagtgcagctttacatgctttgtatctgcaaagacaaaccagtattatcttttcctcacagaataaaatttaaactaacttacattaactatgtctttcttattgcagatttttactcttggtaaatttaagcttgaaatacaatgttttaaaataaagtcatggccaggcacggtggctcatgtctgtaatcctggcactttgggaggctgaggcaggcagatcacctgaggtcaggagaccagtctggccaacatggtgaaaccccgtctctactaaaaaaatacaaaaattagccaggcatggtggtggttgcctgtaatcccagctactcaggaggctgaggcaggagaatcacttgaacccaggaggcggaggttgcagtgagccgagatcgtgccactgcactccagcctgggcgacggagcaagactccgtctgaaaaaaaaaaaaaagaaaaaaagaaaataaagtcacaatttaaaatataaacagtgccatttttcattttaatatggacaccattcttattttataagtcactgtagtattttacaatcaaatttattaaccacatatttgcttcttaataaagacatgggctggacgcagtggctcacgcctgtaatcccagcactttgggaggctgaggcaggtggatcactcgaggtcaggagttcgagaccatcctggccaacatggtgaaaccccatctctactaaaaaaaaatacaaaaattagccaggtgtggtggcgcgtgccagtaatcccagctactcaggaggctgaggaaggagaatcacttgaatctgggaggcggatgctgcagtgagccaagattgtgccactgcactccagccggggaaacagcgagactcggtcccaaaaattagtaataaaatttttaaaaaaagaacatttatgattcatgggagaaggtctaaatatcattatgaacaggtgattagaagatgctgattctataaagggaaataaaatctcaggattcccaaaactcctatgccaaaacaggaatttaaccttggaggctgagtcatgctaaatggccatcctcttcctggacgaataactcttacaagtttgtgtcgaaacattatatattagccagacccccgtggtaaggcaaaaagcctcagccatttcctgatgactaacccgcctcaaaaagtcactcattcgtaaattctttgctagcctcgaaaccattaaaatgtaaatcctcccataacacaaggacaggtccattgtaactccagatctgtagtctaaagtctagttcctaaaacctaaggtctgctagcatccacctgataagtgtcgattcttagctgataattcccaggcacagagcaaaggcaagatgagagtaatcattccttccctgagatgtctgcacaactgttttcttcttctatttccttttgcttcaaaggtttatcttatataaaatgtagatttactgggcattaattagtctcacaagtaggtaaccatttgcctcactgccaccacccctcatgttttaaggaaaatgtataaacactaaccctcctaagaacctctttggacaaaacagccacagatgcatctgtgccttgcgtttttcctgggagcatccttaagctagctcaataaaccttgattgagacagctgcctcagtcactcaattcagttaacacttccaaccctcatggatgagttagggggtcaagacttcaggggaggaagtgactggaggtgtggtggaaacatcaagagaactcagaagtggatcctgaagatgggactgaattgctgcaatctcatgatataacttgaatggataaggagttgcttcttatggatgagaaagtggtttcttgagacagaatctactcctaataagacggtatgaacattgttgaaatgacaacaaaggattcaaatattacataagcctagctgataaggtggtggcagggtttgagaggactgactccaatttcgtaagaatttctactgcaggtaaaatgctatccaacagcattgcaccctagagagaaatcttttgtgaagaaagagtcaactgatgcagctaacttcattgttgtcttattttaagacattgccacagcctccccaaccttcagcaaccaccaccatgatcagtcagcagccatcaacaccgaggtaagaagactggcaaaaggattacaacttgctgaaggctcaaatgatcaacagcattttttttagcaataaagtaattttaaattaagttgtgcacatttttttagacaatgctactgcacacttaacagactacagtatagcataaacataacttatatgcactgggaaaccaaacaacttgtgtgacttgtcttactgcaatattccctttacatgtggtggtctggaactgaacccacatcatctccaaagtatgcctgtacaagaagattgagaatagaatctacttaagtgaaataccatgtttctggaacaagattatggtagaatgaagtggttaaatggatgggctttggattcagactgatctgggtttaaatcctgcctttgtgattcattagctgagtgaccttcaacaaaatcatgctctcagcattgctttcttcctctgtaaaaaacagagatactaactaactcatatcattttacacacacatacacaaacacatattaaataggctgcaacatttactaaaagttcacaaatagcaccaatttaatagtactaatttagccaggcacagtggctcatgcctgtaatcccagcactttgggagactgaggagggaggactgcttaagctcaggagttcaagaccatcctgggcaacatagtgagacagcatctctacaaaaaatgaacaacattagccaggcatggcggtgcacacctgttgttccagcaactggggagaagggtgttcgaggtgggaggattgctagggcccaggaggctgaggctgcagtgagctgagatcatgcaactacactgcagcctaggtgagatcctgcctcaaaaaataaaaaataaaaaaaaggacaaaataaaagaaagaaaaatagaaaaagaaagagaagcaatccaggcagatggaacagcaccaggaaaggcaggaagatgggagagaccatgggccattaggaaactacaagtaattcaatatgcctagaccatggggaatgcagaacttcaaggggaaaataacccagtaatttatctaacatcgtttgcatcaaacataaaatactgaatgctagagtcaaataagaacatatcgaggggacatgagctgagattttcccactaagtttcatgcaagttgaattttcacattgatctctgttgagattaaacatgtgctacaggttgtaaacaatcagaagaaacagagccatgcaatcgagtacagttttacttttcacagaacgttccacacactccctggctcctaaatacccaccttaccctgactatagacctttccccacagcagagaaaagtccatgtcagagagaatgctttagttttgcatatgtgaatgagaaataggcaataaaaaaattatcctgtcaactactgaatgcaggcaacgctgcttagcttgtctagattttaaaggcacactcacctatataagcagtccatatagtctgcacccttgctgtattcttcccagtacctatgatacataacaagtacttgttcttctgactccaaaactctctatataaagaggaaaaatatttttacttgaaaagcaataatcattttcactgtcaacaataaaatgtatcaaaattaatgttctaaaataatttacataattctagctgtacaaattacatttacacaacacatattaactacacgtattaaaaatgaaacaactgggaaagatgtgagtcttcaaaatgaaagtgaagcatccataatagagaataaactgagccgagcgcagtggctcacgcctgtaattccagcactttgggaggccaaggcgggtggatcacctgaggtcaggagttcaagaccagcctgaccaacatggtgaaaccccgtctctactaaataaaaaaaaattagccagccgtggtggcacatgcctgtaagttccagctacttgggaagttgaggcaggagaatcacttgaacccgatcgcaccgagaccccaccactgcactccaggctgggtgacagagcaagactctgtctcccaaaaaaaaaaaaaaaaatcacacttataatgtaacctaaaatataaaattgcaaaaaaattattaatgtcttacatagttatcacttatggtgttaaccaaagctcactagcttacaatagcagaactttaacatactaaacactttaagaccactttaacacacttgctatcaaaagcacttttataagcagataaatgatcacattagaacactaaaatgcacatgccatatactatcaaaagtagagcattttccaatattttcagggaaacagcacacaatcaattgtgccttacttatgagggttttttttttttttttttggtacaggtagtgtctcactatattgcccaggctgctcttgaactcctggcctcatatgatcctcctgcctcagcctcccaaagtacagagattacaggtgtaagccaccgcaccaggccagttcttaccatttaaaaaagtatctactcctgaccacgtgcagggttagacagtttaaataaaactgtgttgttttattcccattttatagataaagtcaaaactcagtccataaggtagttgttaagtgagttgcccgtggttacaacagctaataaaaagcagagtgaagattcttacgcaggcactaaattatctcatccagttcctgattagatcagtagtctaaattaagttggaaatgctgtctatagcaaaatactgcaaaattcactgtttatacacagatcatgtctgtgatgctgcccctctatgtacagcatactaataaaaaaactggtcacagagacagcttctatcaccatttaccatttctttttaattttagattttgggaagacttcatatagcacatgaaaggcagctaaaaagctgaaaataataaagacagagatttaccaagagataggaataaaaaacgagggaaaatttggctgtataaacactatccagaggacgtaggagcacattttaaaactcaacaaaccctgagctgaccctctccttcatttactaattacgagatgctgagcaagtaaactgatttccctaacacagtgcttgactcaaagatcttaatatgtatatatttttaaaatgctgattaagaagcaaaaacaagggaggccaaggccggaggatcactggagcccaggagtttgagaccagcctaggcaatatagtgagacccccatctctaccaaaaaaaaaaaaaaaaaattgccaggtgtggtggtgtgtgtctgtattcctagctactcgggaggctgaggtgggaggatcacgtaagccagggaagtcggggctgcagtgagccatgatcgcgccactgcaccctagcctgggcaacagagcaagaccctgtatttaaaaaaagcagcagcagcagcaaaacaagctgaccttgataaaagttctacactggaaaacagtaaactagtaaagtatacaactatcaacatatttatatcacgtatgtatcattgcttaccttatgcaaatgccgaacatgattttccaaaaaaatcttagtttctgtataaagtctttctccaaggggttcaggataggccacacataaagcatagatatctctagttaaattattaaggttttcatatttattggagacaattttaaaacataatgagatttaccttgtttggcattaaaaaatgaaaaaacatttctttttgtggtttagcttataatatacataatactgttgtatatatgacaagatagaatacataaccatgcttactttatctaagattcattcacttattcattccacaagtatttattgagaattatttgaagacactgtaaggaaaatggttcttatcagagaggttaaaatccagagggagtttctggaaaatcaaattacccagaatcctacaaaataaggtttatattagaatggatattagtatcaatagtatcaatgatattagtattcatagtatcaatgaagggctatggaatatgacaagaggcagacatgtctaagcaattctgagaaactaaacaaaaattattcatttgacacagcctcctacatcatagcagtcaggatactctaccgttattctatcagaagaaatataccatgaataggaatatcaattaagtttctgaacatcaactaagtaccttgctaagtctcaccggaggtagataacagaaggagtggaaagaagtaagacctgagactttacctttcactagccagtgatcttaaccaagtttcctagcctctctcgggtggcatttccttttttttttttttttttaatatcctttgctttattggatcttctcaacatctccaataattagaaacattataaaccaagaagaacaaaagataagacttaaggcaaagcccatttataactttggggccagacacggtattagattatgattctgggaactaggtgtttcatatgctgcctccaactactgtgacaaggcattttggaggtaacagctcatttgtccacaggaacaatgacaccagagcaacacagaggtcaggacctcctggtggttatactccagactgttccatgataaagctatgccatcttatcagtacgatgaccaccaccaagtgtctccaaggtaaagataatgaatctttccctgacatctccacaggtcctgtaagacccaaataaattcatatatgttaaagtactttataaactgtccatcattaaccaaatatagaagataaaggacctatgagcaacctgagaccagcctaactaaagatgcagatacaaactggaaataaggctgatgattcaggatgaagtcaggtattaaagtttaatagaaagattaggaaatactatgaaataaaaatgttaacttaaaaataaggatgcaaattctttctcctctatgtccccccgacacttcatatacattcttctacaaaatttatttttatacagtaaaatttatttatacttttcccaaccacattagcctattcttcatcaactccatactcccagctcccaggcatggttcctagcacttgatgatttattaaatcctgctgaaggaaaggagatgcaaaatcaatctcacatgctccatttacctagcatccttactccagaaagcgcaagcagccctctccacatttatttacttacttataaattttttatcagttctatttatatatttttaagctttatttatttatatttttacttgaaaaaatttttttgtagaaacagggtctcaccatgttgtctaggctggtctcaaactcttgggctcaggcaatccttctgcctcggcctcccaaagtgctaggattacaggtatgagccaccgctcaatatatccactgcatgtaaatgtaaacaaaatctactggaaggatttgtgccaaatctccagcttaaggagaaaggagctacacaagagaggtggtacagggagactctcccatttcattccatatacagtacttctgcactgttggactccttcagaatatacatatttttttaatgcagtgaatccaccttaataaaattttaaagtttatgttttaactcaccatagttttgggtctcaaatcactgtataattttaaccaattaactatgttctttttctctaacctattcaaatatccaaccaaccaggaaacgtttagcccttatgaagaacacctacgaaaatgagattttcaacctccaacactcagttatgacttgattatagacaagacactttaaaagacaaaaaatgttggctgggcatgatggctgatgcctgtaatcccagcactttgggaagccaaggcgggcagatcaccaggtcaagagatcgaggccagccatgatgactcacgcctgtaatcccagcactttaggaggccaaggtgggcagatcatgaggtcaggagatcgagaccatcctggctaacatggtgaaaccccatctctactaaaacacaaaaaaattagccggcgtggtgacaggtgcctgtagtcccagccactcaagaggctgaggcaggagaatggcgtgaacccgagagatggaggttgcagtgagccaagatcgcaccactgcactccagcctgggctacagagcgagactccatctcaaaaataaataaataaataaaaatttaaaaaaagagattgagaccatcctggccaacatgttgaaaccctatctctactaaaaatacaaaattagccaggtgtggtggcacatgcctgtaatgccagctactcgggaggctgaggcaggagaattgcttaaactcaggaggcggaggttgcagtgagccgagatcacaccactgcattccagcctggcaacagagcgagacaccatctcaaaaaagaaaaaaaacacaaaataactaggtcagatttcaacttaaacattctttcactagacttatcttttcctaagtcattttttagggagccagaatacaaaaactcctctatttatgaactttccagtttaaaaatgtctcagtcagaaactaagctgttccagaatgaaagctcatagctgcaaccaaaagacagtcctaaccagcagcaaagttacttattttatttcatgttctctattaaaaggtgtttcctacgcttggcttaattttgagttttaacagtatgaactctattatgccatgggtcaaaaacaatgagagttttgcaatgggaataaaaggaaaggttacctaaaaaaatgaaaatgtaagacaaccaaaaaaggatttgacaattaaaaaaaatatataataaaattaacagtaaaaaagaatttgctgactttttttttttttgagacggagtttcgctcttttgcccaggcagtgcggtggcgtgatctcggctcactgcaaacttcaccctccgggttcaagcaattatcctgcctacctcctgagtagctgggattacagttgagcgccaccatgcctggctaatttttttgtatttttagtaaagatggggtttaaccatgttggccaggctggtctcaaactcctgacctcaggtgatccacccgcctcaacctcccaagtgctgggattacaggcgtgagccactgcgccccgccagatttgctggcatttctaatgagaaagaatacagatgcagtatctacgaaatcatgcattagcaaacaaggataaaaaatgactaattaaatcgaaaattttcaagtgcacagctagtgaatcaatgagaacaaatatcaattagcctgatataatttagaatagggtcaggcagttgctgatgcaccaaatacacctgactatagataaaatcttttcccatctgtaaaatctaagaaagaatgatgggctactacacataatctccatggttactaagaccttcttcttctaacacttgtgaaaagtgtcaaggatacaggtacttgcctcaatatttttcaatgacatcaaaactggtctatgtttgaaagagatgcctgatagaatataaactagaaatgataggtgtggtagcgcatgcctgtaatcccagatactagggaggctgaggcaggagaattgcctcccggaggttggagtgagccaagattgcactattgcactccagcctgggcaacaagagcaaaactccatctcaaaaaaaaaaaaaaaaaaagaaatgaagacaacagtatgcctgggtttaaatggtgggaggatgaactcatattcctacctggaagaaatacgttgagggaaggcaatattaagtctcccctaacaatcattttggacttactataacctttagatgccacttctcctccagtaggaaaatgtctacattatgctgctggagtctggaatggaaatctgtcctaacagctactaaaagagagaaaaccttgagtaaaagtaaactagaacagggccaggtacagtctttctatttatacaaagtccaaaaatcaaagaattcaccattggccggtcacagtggctcatacctataatctcagaactttaggaggctgaggtggggggaatcacttaagatcagaagttcaagactagcctggccaacatggtgaaaccccatctctaccaaaaatacaaaaattagccaggtcatgcacatgtaatcccagctacacgggaggatgaggcatgagaatcacttaaacccaggagggggaggctgcagtgagccaagatcacaccactgcactccaacctgggcaacagagtgagaccctgccacaaaaaaaaaaaaaaattcaccattattgtttattctatttatataaagtccaagaaaattcaccatttaagaaccacaaaagggccggacgtggtggctcatacctgtaatcccagcactttgggaggctgaggcaggcggatcacgaggtcaggagatcgagaccatcctggttaacacggtgaaaccctgtctctactaaaaaaatacaaaaaaattagccgggcattgtggtgggcgcctgtagtcccagctactcgggaggctgaggcaggagaatggcatgaacccgggaggcggagcttgcagtgagccgagatcgagccactgcactctagcctgggcgacagagcgagactccgtctcaaaaaaaaaaaaaaaaacgaaccacaaaaggctgggtgcaatggctcacacctgtaatctcagcacttcaggagtgccaaggcacatggaacacatgagcccaggggttcgagaccagcttggccaacatggcaaaaccccatttctaccaaaaatacaaaaattagccaggcatggtggcgggcacttttaatcccagacactcgggaggctgaggtatgagaatcacttgaacctgggaggtggaggctgcaatgagctgagatcactgcactatgcctaacaaaaaaaagaactacaacgcactatgtctaataaaaaaaaagaaccacaaaaacaacaggcacaaaaatcaagatagtagttagctcctagagaaacgggtgggattgtgaacttagagggtcacgtgtttcgggtgggggttatagtgaatgtggacaatgttctattgttcaatgttctattgataatgtaattgcttgcattataattatttgtgcaaaggtgtattttatgaacttgtccatatttgtgttattcacactccccataaatgcatgctaaaagttcaaataataacacatatttgaaacaatgtggagggacctgttttttccttttcaaagtatttacattgtatggcccttaaaatttccacttaagatattaagggtcagaagtgaactttatattcttgggcaaaataacagggaaaatgatggaattttaccttataacaattagtagcatagtcttttatttatttatttttgaaacggagccttgctcttattgcccaggctgtagtgcaatggcccgatcttggctcactgcaacctctgcctcccagggtttaagcaattctcctgcctcagcctcccaagtagctgagattccaggcacccacaaccacgcccagctaatttttgtatttttagtagagacgaggtttcgccatgttggtcaggctggtctcgaactcctgacctcataatccgcctgcctcagcctatcaaactgcttgaattgtaggcgtgagacaacgtgcccggcctgtactctttaatcattatttttgcagactttttattttgggggtgagagaaaattcatgatcaggtgaaaaataactggcccagccaccagctgggcaaggtggctcacacctgtaatcctagcactttgggaggccaaggtgggagaagtgattgagcccaggagctcgagatcagcctgggcaacatagtgagaactcacctctacaaaaaaattttaaaaatcagccaggtgtggtagcacatgcctgtagtcccagctactcaggaggctgagataggaggatctcttgagcctaggaggttgaggctgcagtgagctatagtcacaccactgtactccagcctgggtgacaaagtgagaccctgtctctaaaaagtaaaaattaaaaaaaaaaaaaggataactaaaccatattagatggaccaaacaaataacatcagagaaataacagtgactgaaggggtcactttccagggaagtaatctatttcaaaaccacttaaaaaccaagaaattcactgtcgattctgtacaatgatgaagaacacattttaattattttttctttacctcctgttcattttccctcttcttgctcttcttgtagtcatctataaccaactcctcttccctctctgctccttgttttagctaaaatatccttaaaagcacctatgaacttgcctagcccaatctcactaacacacaagtagcaacactttttcaacttttattaagattcttgccccaaatcaatccataatgttccacagaaaaattagctatctaattcaaaggcagaatctatattggttatcctctagatatactggaaagcataggaaattggatctttaagatactatattcaagtctgtggtccatcaattactacccgtatgaccctgggcaaataagtcccttacctctgagatcagtttccttatccgttacagtcaagtaattatttttgccccactgatctgatagacttgtttgaggtatcaaacaacataaaaaatataaaagatcttttcaaactttgaagccttccaaaatgtcatcacccttttacatatcttcagtgcccagaacatagttggcttaacaaacttttcttactgcctactgcagttgtaatgaattaaatggttttctgttggtctaaagaactttactcttcttgcatccacattcagcttaatattaacaactgaattaggcattcagaacaagctgaactactatcttatgaaatcagagcttttctaaagaatgtacgccccatataatgagggcagcccttctgtagccccagaagattgctagagagggcagcactagttaggtctagcagatcactgtcatggaggaacacaggaaactaggcttcagggcatcctagagaaatcaccaatctgcattgttacataaaactctcaattcacacatgtaggcaatctaatgaaaaacacacttccaccccagtcactgaacttgctgttcactctccagcaagcacactcttccccccaaaatcacatggcttgctccctcgctgcattccagtctctgctctaatgtcaccatcctcagggaggccttccttggccacccattctaaaagagcagcacccacacaggtgctccaagcctcccccacgtccttatcctgctttcatttatcacgacctcttcttgaaagcaatgacattagatttttttttttacctgtttagtgtctatttctatttttataatagaaaggaatttttttttgttcaccaactgtattcccaaagcctaaagtagtccttgacagatactaagtactcaacaaatacttgttgaatgaaaggttatcaaatactgattgccataaaagaggtgatgaacttggaaatgtagatgataatatattagaaaatagttacatgggaaagttcttccataacattgaacatgttctcagttttcaacaaatttatcaattttagaacattgatcaagctgccattaaaaggatacgagaaacggtcattccatgttgctctttcgacgtattccaacatgaccacggcttttattgtcgtcaaaagtttgttccatgtttcatcaaaatctactactcttggtttcaaagacattgtgcaagtgtagtgttgaaatctgtcaattaaaaaacaataacaatgttagcaataattccatgagcttagtttttttgttgttgttttttgtttgtttgctttgagacggagtctcgctctgtcgcccaggctggagtgcaatggcgtgatcttggctcactgcaagctccgcctcccaggttcacgccattctcctgcctcagtctcccaagtagctgggactacaggcacccgccaccatgcccagctaattttttgtatttttttttagtagagacggggtttcactgtgttagccaggatggtcttgatctcctgacctcgtgatccgcccaccttggcctcccaaagtgctgggattacaggcatgaaccatcacacccggccagttatttgtttttaaagcactacataattaaatagcatgatatatgcaaggagtgagaaaagaacccggcacacaacaaaatgttagctaccatcttttcatgactatccagacaagaaatttcacagactatttacattcattacaagctctaggaaatggaaagcttctagtacaaattatttatgatcaagggtatagtttcaaagatttatagtcctcatttaatattgcgagggaaagaaacggggacccacttaaccaaaaggccaacttccatcatgggaaataatgcaggacattcaaccgaaaggttttggccccaaatccttgtggtttgcactcctgaaagtggggaatgaggcagcatgcaagggaatatgagaagacacaagaaaatgaaaggctttaccttcctggagcatcagtataagattagggaagaaatttacatttatattaaaccaaacagggatgaattatggagtagaatataaaattcacatgaccttttaagattaaaaaaaaaagattccacagaaatgtcaggtttgcagtggagagcttaaggctccttcccagattcttggggtatctacctcccagttctaatgaaaagcatggctctagcatggaatccctggctccagtgaacttaatgggcttttttttttttttgagacagagtctcactctgttgcccaggctggagtgcagtggcgcaatctcggctcactgcaaccttcacctcccaggttcaggtgattctcctgcctgaacctcccgagtagctgggactacaggcgcccgccaccatgcccggctcattttttgtatttttagtagagacggggtttcaccatgttagccaggatggccttcatctcctgacctcgtgatccgcccacctcggcctcccaaagtgcagggattacaggcgtgagccactgcacctggcccagaatgggcttttaagggagttcaaagactcctgcctcagacaaactgcatttaggaattagctggtttctggaacaaaagggtcccaaattaaaagagaaactttctaagctaaatgtaattgctcaaaggaacatttttctggcaaatgttttaacagcctccctcatgtctccccttattagcaggactgtaagacaccaacctagtctgtagccaaggccaaaaaaggatgaaacatcttttctcgtctcccatcataggggaaaggggaggcagagaatggggaggagggaatgatgcataaagagaatgggcaaagggagcgggtaggatggcggccgcaccaccagccacggactgggagaggcccttctgtgtttccagatgagaagagagctcaaggaatcccaggaatagactccatggaaaagaatgaaaaaaatcagagaaaagccaaatatccaaaagagggtatgccttgttgaaccacatcctctttcctcaacattccaaagcctccacctcctggccttcaactcattcccgaactatctataacggattagcagcgattttactctgcaaaattgaggggaaggtgagagtggaggaggtgggagaacctactgagtttcctaagctctaaataagggaattaaccatgcctccttctcttccttgtttactacatcctatcatcaactgtgcacatgagtatttcctgaatccatccatacttgtatagccctacaaatgatccggaatcaggccctcagcagaaatagtaacagttaatatttacattgtgtatactgcaagccaagcactagtctaagtaccctgtacaaactcgtttaatcctcccaacattctgacaggtaggtccactgttgtccccattttcttttcttttctttttttttttctttttctttttctttttttttttgagatggagtctcgctgttgtcagcctgggctggggtgcaatggcgcaatctcggctcactgcaacctctgcttcctgggttgaagtgattctccagcctcagcctcccaagtagctgagattacaggcgtctgccaccacacccggctaattttttatttttagtagagacagggtttttcaccatgttggccaggctggtctcaaactcctgacctcaagtgatccacccaccttggcctcccaaagtgctagggttacaggcatgggccactgcgcctgacctgttctccccattttctgaataagaaaactgagtcacaagtgattcagaaacttgcttaaggtcacaaagctatgtaatggtggcatcaggattcagacccgtgctgcggccggtgctctaggctgctgtgtgcaaccatgctacctcactaacatgcttggtgaatacttactccttgccaggcaccattccaagctctgaggatacagtggacaaaacaaagttcttgacttcaagatcagaatctcagatcttgcccttatcaaagacacaaaaataacctacctaagccaaaaagttgaccatgttactctgtacataaagtacaaagtttgttgtttccttctacagacagcattcagtttgggctcaactgcaacatggcacccaagcttcctctcctcctggtactccctactgtgacatcataatctaggaacttctctctgcttagagatcactgaacacatcagcctgattcatacacttgcctttacccttactattttctctacctaaagtgcttatcttttccttagctgccccctccacccattccacctaactcccactgatagtctaaccttggtccactagctttttttttgtttgttcctgagacagagtctccctctgtcacccaggctcgagtgcactgcaacctccacctcccacgttcaagtgattcacctgccacagcctctcaaggagctgggggattacaggcgtgagccatcgcaccctaatttttgtattgttaatagagacagggtttcaccatgttggccaggctggtctcgaactcctgaggctcaagtgatccgcccgccttggcctcccaaagtgctgggattataggtgtgagccattgtgcccggccttcatctgcttttaagaaactttcttggaccatttaagctaggtaaggtgtcctatcataggtattacctgagaactccacactttcctctattagagtacttcatcgctctgaactgtaattacctgagtgtttctgagagtggggacaattctgtaactgcgtaccaaaaagctagcgatgctcccctcacattcgctttctcctcttataaaatggaatcatattatacacactgcttgtaaattagtttaacagttgcacagactttttttgctttatggaatcagactgacactgacttctctgttgagactgatagatttctggtaccataggaaaatacagttacaatccatgcttggatggatagcaaatctggaagccaacgtgcaagaagcaccagcctcgtgaaacacaccaaaaactgacaaaccaatagcaggaaggtatgctgagacagtctgtcaagattctctgcttgcccagcagaaagctcatataactaggaaaattaagtttcttaaaaatgtttaataataacattcagggaaagtttacacaaggatgtgaaagagacagggcaaagaagaaaaaggaccacagtcacactatttctaccccccaagctgtcaaacaactcataaatctatcagtcttgttcttcattcctgtgccttaacgagattcccacgcgcactcagattgtgtcccatcaagttaactgcaaaaatccaaatctcctgaaatcaccacagtcccttttagtttccttgtgagttccactcttgcaacaatggggttttagacacacaggtccagtggctagggccacttatgggccctaaaacacacacacacacacacacacacacacacacacacacacacacacacgcacgctccacatttttaaaaattgcaaaataaaaatttatatttaattacctgtttccagaaaacattatgtcaacattaatacaatatttgcaacatttttattacatttgaaaacacttgtagatttgatttcctcacagcataatttctaaatatgcatgattgtcaataataattacaaaagtgaattataaaacgcagctaccatatgacccagcaattccactccgaagtataaagagaaataaaactcccaagagaaatacaacatattcacataaaaactggtacacaaatgttcactgtagtattattcataaaggcccttgaaatagctcaagtgtctatcaactgataaatggttaaaatgcaatatagccatacaataaattattatttggcaatacgaggaaatgaagtactgatacacactatcacatggatgaccctcaaaaacattctactaagtgaatgaagagggccacaaaatagccacataacgtatgaatctatttatatagattatcaagaataggcaaatctagagacagaaagtatgtgagtggttgactagggaacttggggggaaaatgggaaatgactgccaacagggtgaggaaaatgctctaaagttgattgtcatgatagttgcacaactctgggaatatactaaaaaccattaaattgtatatttcaaataggtaaactgaatggtatgtgacgtatatctcaataaagctgctatacatttaacaatgaattataaaatcctgccaaaaattttagagcaatttaacggggatgaggtggaagtaagtatcaatacatccatatggtcatttagcataaaattctgaaatctcaatctctctcccaccactcccgtgtacgacctcattgccacctcccattgaatgaggcaataaatgttatatgttcctgggtgtattttatacatatatgtgatttgttactcccttttacataatataaacatggtatttttttcatctgttttacataaatggtatactattcagattgttatatatctgcttttttctcttaaaagtatatttgtggccaggcacggtggctcacgcctgtaagcccaacacttcgggaggccaaggtgggtggatcacctgaggtcaggagttcgagatcagctggctgacatggtgaaaccccatctctactaaaaatacaaaaaaaattagccaggtgtggttgtgggcacctgtagtcccagctactccggaggctgaggcaggagaatggcgtgaacccaggaggcggagcttgcaatgagccgagataaaactcccaagagaaatacaacatattcacataaaaactggtacacaaatgttcactgtagtattattcataaaggcccttgaaatagctcaagtgtctatcaactgataaatggttaaaatgcaatatatccatacaataaattattatttggcaatacgaggaaatgaagtactgatacacactatcacatggatgaccctcaaaaacattctactaagtgaatgaagagggccacaaaatagccactgcactccagtctgggcaacagagcaagactccgtctcaaaaaaaaaaacaaaaaacaaaaacaaacaaacaaacaaaaaaaacaaacaaaaattagccgggtgtggtggtggctgcctataatcccagctactcaagaggctgaggaggagaatcgcttgaacctgagaggtggaggttgtggtgagccaagatcatgccactgcactccactctggacaacagagcaagactccgtctcaaaaaataataataataaaataaaaagaaataaaaatgaggccagatgtggtggctcacacctgtaatcccagcactttgggaggccgaggcaggcgcattacctgaggtcacgagttcaagaccagcctgaccaacatggagaaacccggtctctactaaaaatacaaaattagccgggcacggtggcacatgcctataatcccagctactcaggaggctgaggcaggagaatcgcttgaacccaggaggcgggggttgcggtgagtcgagatcgtgccattgcattccagcctgggcaacaagagtgaaactccgtctcaaaaaaaaaaaaagaaaagaaataaaaataatattaaaaatatatatttacagatgtaatgatatgctgtctgaaatctgcttcacaattaaacagcttgctcatgagttgataactgttaaggatgaataaaagggacatggggatttattacaatattctttttttgtatgtgtttacaattttccataataaaggaatttaaaaatcctactcctcataaacattaatattttcataaatttaggggagaaagcacatcatctctaactgaaagccgttactaaccttcccttctgagaatcttaactttcctgtgagttttaggtttccaaagttgtaggagagctcacaaaacacatggtactgtccctaaatgtgatgtgttaacatagcctgacaaaatgtccacccctaaaaaacttaaattactaatagcagaaataaaaaatatatatgtttgttaagatcaggtgaatttttttttttttttttgagatggagtttctgtcttgttgcccaggctggagtgcaatggcatgatctcggctcaccacaaccttcacatcccaggtgtgagcaattctcctgcctcagcctcccaagtagctggaattacaggcttgcgccaccacaccggtgtaattttgtatttttttttttagtagagacggggtttctccatgttggtcaggctggtctcaaactcccaacctcaggtgatccccctgcctcaacctcccaaagtgctgggattacaggcgtgagctactgcacccagcccgacatttttcatataaagagatttgttcctgtgaactcacttgctggagcaaaaaaacaatttagataatttcagcaggtaaaagttacagtatctcaaaagatgcattttggtgttttgtattttacttaccttctaaaagtataattatcaataatgtaaatggctaaccacttactattttgattctctttatagtgaacaaaactcctgaatgacgatttatttcagtactgatcagcagcaccaataaaaatttggcatccaaaaattatcagtaagatacaatagagtggtctaagttgacttcagatagttaagacaccataattagttttttaaatgccactcaataggcttagagcagatttccttccaaatgcataaaatgagaaaatactgaagacccaataaagagccttacagcagtcccctgccttatccaaggggatacgtttcaagatccccaggaatgcccgaaactatgttttttcatatacatacatacctatgataaagtttattatataaatcaagcacagtaagagattaacaaaaactagcagtaagatataacaattataacaatatgctataataaaagttacatgaccatggtctctcagaatatctcactgtgctgtactcgcccttcttgtgaaggtgtgagacaatacaatgcctatgtaatgagatgaagtgaggtgagtgacacatgcatcggaaggtcggcattgggctacttactactgaccttctgtattcctgaatatgtgttacagtccctgacttagagtaaatggtttggtgtcattcgtctctggggatcccttgctgagtcttcaaataggctcaatgctttctggcacagtatgttgccatcaagtggaacttgtctctgctcatgtcttccacccaccagtgtaatgccttttccaaattaactaagcacttattacacgatataactatcacttttacagattgagatttgacagcaaaactagtaagaatttctttcttcacaatttcttttctttcataattgtgaagaaaaagaaattcttattagacctgcttacagtaggtcttagcaatctcagtctattatttttttctttcctcattgagaactttcaacttttcgtgtaaaggaagcactctatggcagaagcctctctggtgtatccatattgctaggatcactactcctgtactttgggggcccttactaagtaaaatcagggtgacttgaacacaaatactgcaaaactgcaacagtctatctgataatcaagacagctactaagtgactaatggcaggaggcatccacagcgtagagatgctggacaaagggatgattcacgtctgagcaggacagtgcaagatttcatcacactactgaggacagtacagaatttaattatgagttatttctgaaattttccatttaatatttgcagaccccattgaccgtgggtaactaaaatgcagaaaacaaaactgtgaataagggaggcagggaagtggaataccatattaacttggcattattttccatttccataggtgggcccaaagctgccaatggtgcacaatgaccaaatatgttgccatcatttaatattaaaataagctccaagaatgcatctaaacattttcatcttgctgtatcaaatgagcaagccactggatgtaactaagaatgccctttcttatttggaggttaagggtgcaatgttttttgttgcactaaggtttgacccacagagctctaagtactccataaacaacatttccatcatgactttctggctttagaattcctatttttatttatttatttatttatttatttatttatttatttatttatttttgagacagggtcttgttctgtcacccagtgcagtggtgtgatcctggttcactgcagccttgacctcctgggctcaagtgatcctcccgcctcagcctcctgagcagctgggactacaggcacacaccactgcactgagctacttttttgtatttgtagagatggggtttcactatgttgcccaggctggtcttgaactcctgagctcaagcttccaccagccttggcctcccaaattactaggattacaggcgtgtgccaccgcacccagcctagaatttctagtaggttttttacaaaaacaaatgagttggggaaaaaagagtgaacagacatatggtgtgtgccaaaatgtatactgcaggaaaacatcttgaagtctcaaaaagggtgacacggtggggagtagggaatgtattcataatacaataagttacagaagccatttgcacccaggtgtggtggctcacacctgtaatcctagtactttgggaggctgaggtgggaggatcacttgagcctgggagtttgaaaacagccttagcaacatagacagacctggtctttaaaaaaaaataaaattatagtagctgggccctctggtaacatgcgcccgcagggagtcccagctactcaggaggctaaggtgggagcttggcttgagcaaaggagacttcaaggttacattaagctacaatggcaccaccacactccagcctgggccaaaagaccaagatcttgtcacaaaaaagcagctacctgcttccaaaaataaacccactgcaccagaataaaagacccctctctgcaatgaactttagactcccataagactgcacagcctatactttgtttcttaagttttcacatcgctcttatcagcttgaagtttaacgccattttcacttgctttctcattttttgttcaataatctagtcaacgaatttaagaaactgacatttttaaaaaaaactattctcatatatgtatccccgatctcaggtaaattagagaatttgaatttctgagtccttcatgactaggcaagcccatcgtgtatgaatactagacaaagctagaaccaaccagcctttacacaaattatcaaaacattgagaacaaattttttggctgtgtgcagtggcccatacctacaatcccagcactttgcgaggccaagatgggcagactgcttgagcccaggagttcgcagccaacctgggcaacatggtgaaccccgcctgtacaaaatacaaacagatcagccaggtgtggtggcatgcacctgtagtcccagctactagggaggctgggatgggaggatcacttgagcccaagatgtgaccgcaccactacaatctactgtatttgctgactgctatataatacattaaatcctgcctatgtcctgacactgctatagaagacacaggcatggaagaataattaaaaaggggatacagttatggcagatgcatatcaattaaccctctagcaactttcttgacacctcctgtttacaatcccaaagagagccagtgagttggatcaagtttgtaatcccagcattttgggaggccaacgtgggaggatcacttgagctcaggagttcaagaccagcctgggaacacagcaagacatcatcttgactgaaaaaaaaaaaaaatttgcctgcagtgagttatgatcacaccactgcactccagcctgggcaacagagccagaccttgtctctcaaaataaaaagttccgatatatgctacgacaaggattaaccttgaagatattacgctaagtcaaatacactagacacaaggtgaaaaatatcttatggtcctatttaaacaaaagtatgtatgtgggcaaattcataaagacagaaagaaggatgagatgttatcagatgctgggggaaggggaaatggggagctactgcctaatggttgtacagtttctgtctagtaacgaaaaagttttggaaatggtggttttggaaatggtggtgagggtcacaatgacactgtaaatgcagttaacaccactaaactatacccttaatgacggttaaaatggtaaattttatgtcatgtatgttttaagtgcttaaaaactagatcacaggtacaaagttctgatgtcagagaagtatctgaatctcactgcaaaatgctctctaaaaatttttaaatggatgcattctaatcaaaataatacttggtactatgatgacaaaatactatttttggttcagacagacttttatcaaataaaagagaaatatcttgagataaaatttttctgaaggctcaggactacttggggatctttctcttgatgtcacattattcattattttggtaactatacacttacataattacaaaggtatctttggctgagcatggtggctcatgcttgtaatcccagcagtttgggaggccaaggcgggcagatcacttgaggtcaggagtttgagaccagcctggccaacatggtgaaaccccatctctactaaaaatacaaaaattagtcggtgtggtggcaggtgcctgtaatcccagctactcaggaggctgaggcaggagaatcgcttgaacccaggaggcaaaggttgcagtgagccaagatcgagccactgcactccagcctgcatgagagcaagactccatctcaaaaaaaaaaaaaaagaaagaaaaagaaaaaaagaaagctatcttctatttcccaccgtcagaaaatagcagttataaataaaggggaaaggcaagcattaatcctgtggtaatgagttgtaatcaaaggtatcatttacaaactcatggttttgaatacacaaacacacatatacatgcagataaaaagatataaacatagatgtttgtgtatgcatggttgaatatacatatatttctagctctgttcactgagaagggcctaggaggaatgacaccacagtggcaatgggcacacatagaacttagatcttggtttctaaatatcattctccaaaaaaaggaaccagagctcctccttggaaaagtgattgattccagggctgaagcaggaaaaatacaagttgaacctagaacacctatgatgtcagaaaatagaaggtgctttccccccacaaagagggtgggggcatatcgaaaggacacaagttaaactaaaggtcaaaactggaacaaatcagagcaacaaaataatgaatgataggattagattataaaccataggcgggtcacagtgactcatgcctgctgtaatcccaacactttgggaaaccaaggcaagaggactgcttgagccaaggagttcaaaaccagcctggagcatagcctgtactttctctccttcaactgaattaaaacaaggctgagatatttttaaaaatttacatatggcaaatccatgtttcattctttgaaaagcaacctacaatagagaaagactaagtcactgaattaatagatgtaactaacattatttataatgttaaactatataaaagaggccaggcacagtggctcacacctgtaatcccagcaccttggaaggccaaagagggcggatctcttgaggtcaggagttcaagaccagcctggtcaacatggcaaaaccctatctctactaaaaatataaaaattagtcaggtgtggtggcagacacctatagtcccagctacttgggaggctgaggcaggagaatcacttgaacccaggaggcagaggttgcagtgagctgagatcgcgccactgcactacagcttgggtgacgagtgaaactctgtctcaaacaagcaaacaagacacagtatcagtctgaatttttaattctccagaataacaaagcttaaagcaaaaggaaatattccacctctcctcctccaaaagaaaaatcaacagggttcaaggcaccccggaagtttctacagatccaacaccacaatcttaacctaacactactactgtctcaaaacttttaagaatcaaagggattgtctccaataagcctttcccaatgaaaagccaaatataaagtactgatatagaaatctatacattcttaaaggtaacccaaagattatgctaactgcaatatgacagatacgttaccagtaagattcaaacccaggcacagagccaaatcactctgaatagatattgtgattaactgattactgagagagggttcagtcatacatctcatagatcaataacttgttataaatctcataacattccaaatcgctgcttgtttttccaagatttaacatgagccagtcataagtcctcataatattaagattctagggctgatcctgtcatcaatttacttaaaaacaactgatagttggacaggcctggtggctcacacttgtaatcccagcactttggtaagccgaggcaagtgaatcatgaggtcaggagttcaagaccagcctggccaacatggtgaaaccccgtctctactaaaaatacaaaaaaattagctgggggtggtggtgggcgcctgtaatcccagttacttgggaagctgaggcaggagagtctcttaaatgccagaggcggagaatgcagtcagccgagattgtgccactgcactccagcctgggtgacagtgtgagactccatctcaaaaaataataataataaaaaataactggctgggtgtggtggctcacacctgtaatcccagcactctgggaggctgaggcaggcagatcacaaggtcaggagattgagaccatcctggctaacacagtgaaaccccgtctctactaaaaaaatacaaaaaattagccaggcatggtggcggctgcctgtagtcccagctactttggagactgaggcaggagaatggcgtagacccaggaggcagagcttgcagtgagctgagatcgcgccactgcgctccagcctgggcgacaaagcgagacaccgtcccaaaaaaaaataaaaataaaaataactgttagggccaggcgcggtgtggctcacacctgtaatcccagcactttgggacactgaggaaggcggaccacaaggtcaggagatcaagaccatcctggctaacacggtgaaactccatctctatgaaaaatacaaaaaattagccgggcatggtggcaggcgcctgtagtcccagctactcgggaggctgaggcagaatggtgtgaacccgggaaccagagacacagccagactctgtctcaaaaaaaaaaaaaaaaaaaaaactgatagtgcatatgaaacattgctttcaatcacagccagacatttttccagaatacacaaagaacaggcagataaggtagaacacaaaacaaacagtgcaaacttttgtaaagtctcacaaaaagaaacagctttttacagcgagggaggaagggcataagggttgaaaaacggttgggtactatgttcagcacctgagtgacgggatcattgtatcctaaacctcagcatcacacaatatacccgggtaacaaacctacgtgtgtacctcctgaatctaaaatgaaagttgaaaaagataaaaataaagaaacaagcagcctggccaacatagtgaaaccttgtctctactaaaaatacaaaaattagctgagagtggtggagggcgcctgtagtcccagctcgggaagtggaggctgcagtgggctgagattgagcccctgcactccagactgagagactctgtctcaaaaaaaaaaaagaaacaagaaacaaggccgggcacagtggatcacgcctgtaatcctaacacttagggaggctgaggtgggagaattgtttgagcccaggagttcgagaccagcctgggcaacacaatgaaactctcttagttctgtcacccaggctggagtatagtggctcactgcagcctccacctcctgggttcaagtaatcctctcacctcaacctccctagcagctgggattacaggcctgcaccaccacacctggctaatttctgtattttttgtacagacagggttcgccatgttgcccaagctggtctcaagctgctgggctcaagtgatccacccacctcaacctcccaaagtgctgggattacaggcctgagccaccgtacgtggccggaaacagctttttaaacaactccacacctgtaggtcaaaaacttaacgagaccagcctggccaacatggtgaagccccatctctactaaaaatacaaactccagcctgggtgacagagcgaacaccatctcaaaataaataaataaataaataaatgaacttaacaagggcagggaccaaatcagaaaatgctgcagtactccacagttttatcctctttctacattctctgtgttctcatcctatttcataacttaactactatttaacactctaaaaaatacaaatgtcaaagtaaagtgtactactgtttctgcaaagtgggaacaatatttgcttatatgtccacaaatatttttttccaaggagatctaagaaacagctaacaatgtttggctccaaggaaagctggatgacaagggtacaagaagtggagggagattttcattctattccctactgacaattttatattttggttttctgtttgttttagagacagggtctcactctgtcactcaggctggagtgcagtggtgcaatcacagatcactgccacttccaacctggtcatctggcctcagcttcccaacagcgggtactacaggcgtgcgccaccacgcctggctaatgttttttaaattattttttgtagacatggggtctcaccatgttgcccagactaacatcttaaattttgagccatgtgaatacagtttttgttcaaaacattagtataccaataaataaatgctgatgactctccatatccattttcctctcttcactagaacttaagttccatgaagccagaaattttttaaccactatatccacacatctggtttaaagctggtgcttgagaagccctcgttggatggctgaatcactccttaacctctaagttccacacttatttccaatcacctacttctcacctccacttgaacaacgaaatccaacttaacatgtccaatccaaccccatcccatacaacagcctgcttcccccaacctcttcttcatctcagtacacagcatcatcatcctccagcagaagccaaaaacccagaattgacccatcccaactgcatgctcatccaaaacatgacaatttcaataagtatcttcaactccaaaataaatctcaaaacgttttcacttgtaccttaaccctccacagccactgctcttctcactggtctccttgtgtctctcttctccaatcaacagtctgattctcaatcagacctctcagtttagaagagttccaaaagccttttaatgtatctaagaacaaagccaacatgatccagcccctggctaggacccacctttaatctcttactagggtccaccttaagccaatttcagtttgttcaatccaagtttgatagcacctcagggtttttccatttgttcctccctaaaataggaaaactgttccctcagaatttcaaacttcacctcaggaagttcttttctggttacagtatctgaagtaatctcccaatcactaccacaactccttaccttatttcccacacagcacttattctctgagattatttcttatatactgtctgtctctccatcccaagccagaagtgacactccaagaggatagaaatttaatgggttggacaggtgtggtggctcacgcctataatcccagcactctgggaggctgaggagggcggatcatgaggtcaagagatcaagaccaccctggccaacatgttgaaacccagtctctactaaaaatacaaaaattagctgggcgtggtgacgtgcgcctgtagtgccagctactcaggaggctgaggcaggagaattgcttgaactgggaggttgcagtgagcccagatcgtgccaccgcacttcagcctggtgacagagcgagactccgcctcaaaaaaaaaaaaaaaaaaaaaagaaatgtaatgtgtcttgtttacccttgtaaccttaatgcctgcagccctgcttgacaaataaaccaggtgcttaataaatatctgtcaactgccagacaacgcaaaaatgactttaaagaaggtccataacgtttaatctagtgacaaactggtgagggtaaaagacatggataatcttcacatttatagaacactgaaagccaccagcaaggatggagaatgaagagtatttcagatgcaggagaacatccaaatactcaaaaagcaattgaaaaggaatttttcccacgctatgtgcatgcacattgtagaaatgttcccccaactcataaacagcaattgaaaaaaacaagtaattcaaaacactgtgggctgggcgcagtagctcaggcctgtaatcccagcactttgggaggcctaagcaggcgaatcacctgaggtcaggagttcaagaccagcctggccaacatggtgaaaccccatctccactaaaaatacaaaattagccgggcatggtggcgcatgccagtaatcccagctacatggaaggctaaggcagaagaattgcttgaacccgggaggcggaggttgcagtgagccgagatcgcaccactgcactccagcctgggtgacaagagcaaaactccatctcaaaacaaaaaaactgtgtacttctcttatctcacgcgactcttttggaaggatcttccagatactgtataagggcaaaagaagcaaagtatagctcatttgttcatgtgtctgtcttgaaaaggaatgtaagattctaaagggtaggcaacagtgttttgaatgtttttaagcgattattatgtagtcagttgtcaatcagatcaaagtgattatttccgatactttactacgaaggtaggcttggccaggtctagttcaaagacgtttatgttgaacagtcacaatctatagcgaacgttaatattttgcatcttatcttcaaaatttaaacgcccagggtactggccttcaactgttaatattaatccatggggcaaagatgtggacttaacattaataacagtctgcaattcacagatgttttatttgcatgcacgtaatggtagggaatggtccagactctctagagggtaagcaagtgctagaaagcgtgtgaggatcttatttcaccagaccctaagggttgagacaagaagtctagcatgcacgtaggatactcctccccaaagctatcaatctttgcagtctgcggaaacaaaagtgaaaacactcggggtaaggatgcatgagatgcccccccccacacacacacacaaacacacagagttgtgtattcgtgtgagcacgtaaatatgtagaagaatacacgcactctcaccttccctccttcgaaggaaaatggggccgcgggagaggcggccaagatcgggttggggaggcccgggatccagtccagggggtggcagggcttacgggtcagcgctctggggagccgaggtcacttacaggataccatcttcccgggcctccccctttcatccctctccccacacctcgtcgcccccaactcctctcctccgccccagccccgccacccattaaccgggaagggaagtttcccggcgcctgcagcccggctccccgaccctcagcggggttaccttctgcagaagcagggcaaggggcaggggacaaggggagggggaggcagcccgaaggagtgaaagacgaagccccggcgaggaaggtgggcggaggcggcggcggcggcggctgtcagctcgcgttcccctgctcacagcgctgccattactgtgcgccgaggccgcctccccggccggccgccgccaccggccccggagacgcggggggtggggagcgaagcccggggagcccgcgcgccgacactcacctgtctccgcgaggaaagacagcaaagtccaaggccgccgccgctccccggcgggacaggggcggtagggagggggggaaaggggagaaggacgggccgatcacgggatccgtaaaacaatcgtcctcctctgcctccggctttgcccaacacacaccctccggtctccttcttccgctgctgccaaatcccccccgccacccggaaagcaatggtacaggccgcgttacggcaagcgcagggagccaagcttcgtgtgattgcgaaaggccacggaaattaatattccaagtgattccttgctgggcttgctgtcaatgaggcaattgcggttcgctgagctgatggacacagtacccacccactacccgttagttcagggactgctaataacaatatgttggaatggtgctttcaacagaagtatgttttccttgtttcagacctatgtgaatatcctaagacaccacaatcctcttgccacacacttccatgggctttgcaaatgatcaaaaataaattagcaaaactacttttcctctctgacaaactctttttcttgttagtttttatctacagagaatttcttggacatacatgtattttcgataaagaaacttcacatctttttcactaataccccaccttcaccaagccccaagcctatcagtttgaagggttttcctcccttggagttttaaacggtaaagctgataaaaatatagaattactcatcacctcctcatatatgcagggccacagaggaacaaaagcccggccttagtgctttttgcctttcatatcctcaagagctcaccatcagggtcttgttcatttatacgattcagcaagcttttccctcccatcccttccttccaaactgcacgaacccttcaaggcccatttaaaaccctgcctccagacctgatcagtccctagagccttcctcctcttctaatctgcttctcttggtacttgaagtctctactctttatttcagtaaagggtttttatatacgaaattcaatccaacagtatgtttccattatgtgacctttttttcctcccatgttttcccccttttaatctagtgattctcaaagtgtggtccccagacctctggaaatccctgagacctttacagaggtcataaggttaacaactagtttgttaacaatgcaatatgtctggtcctttttttttttggatacagagtcttgctctgtcacccaggctggaatgcagtggcggcacaatctcagctcactgcaacctgcacctcccgggttcaagtgattctcctgtctcagcttcccgagtagctggtattacagaagcccgccaccacacccggctaattttttgtattttgtagagacagggtttcaccatgtcaccacattgcccaggctggtcttgaactcctgagctcaggcaatccacccacctcagcctcccaaagtgctaggattacaggcctgagccaccgtgtcaggccccccctgctttttgttttgttttgtttttgtttttgacacagggtctccctctgtcgctgaggctggagtgcaggagtgcagtggcctgatcatagctcactgcggcctcaaactcctgggctcaagcgagtgtaccatctcagtttccgaagcagctgtgactacaggcgcgtgcgccaccacacccagctaatttttgtatttttggtagacatggggtctcactatgttgcccaggctcctctggaactcctgagctcaagcgatctgcccacctcagcctcccaaaagttctgggattacaggagtgagccaccatgcctggcctcctctgtctttttgactgagtttgtttttgtactgatggtgcaaaggaatacggacactattgatgccttagcagggatcaagacagtgccaccaacctgtccgggtggtcattggatcgctgtattcttcactgccatacattcccagtttttaaggctattgatttaggaatatcctggatgaagcggaagcattaattttattaaattttggcccttgaatacaagtctttctaatactctgtgtgaagaaatgggaagtacacatgcacttctgcatgccaaagtgggatggctgtcttgaagaaaagcacttgtgtggttgacttacaggctgaactacctgcatttttcatggtgaaactgcctttgcaaaacatgatagtaagaggaatctgacctcattgatttaatcttgcttctgacctccaaggtgttcctggtcattcctgggcataggccaacttaatttggggaggaagttagtttatggtttaacttgaaagctaagttcctccctaaaactacccctgctcttgcttagggatgaaaaaccacctttggaagactaatgaaaagcagcaagaataggattatgggaggggtgtgaactttgctaaagtgtaggcatatttctattaatatactcccttactgctcaggggtcatgtggccagaggtcacaagatttgtgacttccccagttgctcctataaataacatcagtattgtacaactttagattgctttttgagatatttttcagactgaccccacctggactcgtgactcatgactcagaactggtcctatggccccacccagaggcaggctcagcactcaaggactgttttccacacccctatgattccatccccaacccatcagcagaacccattctctagtcccctgctcaccaaattgtccataaaaaccccaacctccaacccagggggagactgatttgagtgataactccagttctcctatgtgactggccttgggtcaattaaacactttctctactgcaataccttggtctcggtgaattttgtctgtgcagtagccaagaagaacccatctggccattacaatggaaggccatttttacttgaaagaacaattgacagacttggtggctcatgcctcccagcactttgggaggctgaggtgggcagatctcttgagtgtaggaatttgagatcagcctggacaatatagcaaaaccccatctctacaaaaaatacaaaatttagccaggcatggtggtgtgtgctggtagtcacagcttcttgggaggctgaggtgggagaatcacttgaacctgggaggcagatgttgcagtgagccaagatcacgccatactgcacccagcctgggcaataaaggcagaccttctctcaaaaaaaaaaaaaaaaaaaaaagaaaagaaaagaagaagaaattaccacttgttgaatttcactatagtatcaaagaagaatatccataattatccaaaaagactatttaattttctttcaaaggcctgagtttcttcatatatttcaaccatagagaacctagctatcttctattaaatcaaatatttagagagttgcaaaaatacaaaagcaatccttttcctctgatcaaattttttttattttggaaaatatggttatttttcataaaagcatgcaatttatgttaaatgtgtttggtttattatttttaaaattaatcagtaatttaaaaatttttatcctttaaatttctaatacaataactatttatagatagatagtttcctgaggcctccctagacactgagcagatgccaggatcgtgcttcttgtacagcctgcagaaccatgagccaattaaacctctttatttcatcaattacacagtctcaggtatttcattataacaatacaagaatggcataatacaatagatataacccacatgaacataagctcttctaagtcctcgataattttttttttttttgagatggagtttcgctcttgttgcccaggctggagtgcaatggtgcgatcttggctcactgcaacctccgcctcccaggttcaagctattctcctgcctcagcctcccgagtagctgagattacaagcacgtgccaccacgcccagctaattttgtatttttagtagagatggggtttcaccatgttggtcaggctggtcttgaactcctgacctcaggtgatttgcccgcctgggcctcccaaagtgctgggattacaggcgggagccactgcacccagctagagtaatttttaagcgtgtaaagaaactgaaaagtttgagaaccactgctctaactcatgaaattccttcactctcatcatgttcctcttaactctggttggaaatgtgatcgagcgtgaagggtgccaaccatgaatcactataacagccccctttatttctaaattccagagattgcccccacctcttgacagtttacccaaactctacagtagggaaataatattcgtaaaatagttattagcatccaagcccttaatatcaaagtgaaattacttcttttccagaaaaaaaaattctttctgggtaaccctttaagttaccacttttagcattagttggtccttactccccaaacaaacctcaaatcctagttcatctatgattgctttccttgttttactttttagctaatgctacattttacaaaactgtgttttggccttgtatgtttatttaattcctttataattgtttctgacttcaaaagtaatgttggcggggcacaatggctcacacttgtaatcccagcactttgggaggctgaggctggtggatcacttgaggtaaggtggatcacttcgagaccagcctggccaatatggtaaaaccttgtctctactaaaaaaatacaaaaattagctgggcatagtgctgcatgcctgaaatcccagctactcaggaggctgaggcaggagaatcacttgaattcacaaggtggagattgcagtgaaccgagatcatgccactgcactccagcctgacaatagagcaagactccatctcaaaaaaaaaaaaaaagaaagaaagaaatacatgctttttgtaaaaactacctctattacagaaatagagaatcatgtttgggttgatgtacataactcacaatttatttctatgaatatgattaaatatatttttatacgtatcagaacatataatatatatgctattttgtagtcagctatttgtacttctctgattttgatctttatgaaaatgcaaataattattttgtgtgtgtgtgtatatatatttttgagacagagtctccctccgttgcccgggctggagtgcagtggtgtgatctctgctcactgcaacctccgcctccccggttcaagccattctcatgcctcagactcccgagtagctggaactacaggcacatgccaatacacccagcgaatttttttgtatttttagtagagacaaggtttcaccatattggccaggctggtcttgaactcctgacctcaagtgatccacccgcctcagcctcccaaagagttgagattacaggcgtgagccaccaagcccggccagttatgtcatgtattaaacatttttctaccttttattttgggatacccctagatactgtacaacagttttaacgtttggagtggctcattaaggagctattttgaggctgggcgtgatggcttagcctgtaatcccagcactttcggagtccgaggcgggtggattgctcgaggccaggaccttgagaccagcctggccaatatggtcagaccctatctctactaaaaatacaaaaataagcctgggctggtggtgtgtgcctgtaatcccagctactcaggaggctgaggcaggagaatcacttgaacctcagaggcagaggtttcagtgagttgagatcttgccactccagcatgggcaacagagtaaggctctgtctcagaaaagaaaaaaacaaaacaaaacagctattttgagcttacaaaagtgcgagtctctttaaagaagtggctgacgtgatggccgggtacagtggctcatgcctgtaatcccagcactttggaagatggggatagaagggttacttgaggccaggagttcaagaccagcctgggcaacagagcaaaaccctgtctctatgaaaaataaatacaacaaaatagcagctgggtatggtggtgcatgcctgtagtcccagctactctggaggctgaaatgggaggatcacttgagtccaggaggtcatgtttgcagtgagctgtgattatgccactgcactacagactgggtaacagagccagaccctatctttaaacaaacaaataaacaaaactgtataggttaagaaagtaaggaagtactaaaaaacaaaacaaaacaaaatctgcttccataagagtatttcaaaggggcacaggagccaactgagagacagatggtgttgtttgctgaaactaaattgctcgtgttaggtttttagtagtagaaagatgtagcttcaggtccacttttttttttttttttttgagatggagtttcactctgttgcccaggctggagtgcagtggtgcaatctcagctcactgcaacctctgcctcctggcttcaagtgattctcctgcctcagcttcccaagtagctgggattacagacgccttccaccatactcggctattttttgtatttttcgtagagacggggtttcaccatgttggccaggctggtctcgaactcctgtctccacatgacccgtccacctcaacctcccaaagtgctaggattacaggcgtgagccaccgtgcccagcctcatgccccttttcttcaaaggtttaccttatcttatgtaaactgtagatttactgagcaccaactaaagtgtcacaagtaggtaactatttgctcactgccacccccttgatttaagaaaaatgtataaatactgaacttcctgcgaacctctttggaaaaagcagccagatgcatctgtgccttggatttttcctagctgtacccttaagctggctcagtacacctcaaggagggaggattgcttgaggccagaagtgcaagaccagcctggggaggctgaggtggaaggattgcttgagttcaggagattgagattgcagtgaactgtgatcgcaccattgccctccagcttgggcaacagagcaagaccccctgtctcaaaaaaaaaaaaaaaaaaagaacttacagtggtgcaatctgacaaatacccttcagtcaggtgatcaagcccagtattaacaatgtacccttggcatgatgtgctgagaatggcactttacctctgtgatcatcctccccaaacccctaagcccagtctatcatgagaagaatattagacaaattcctgctgggcacagtggctcacgcctgcaattgacactttgggagtccatggtgggtggatcacttgaggtcaggagtttgagactaccctgggcaatacagcaagaccccatctttaccaaaaatacaaaaattagccaggcttggtggtgcatgcctgtagtcccagctactggggaggctgagacatgagaatcacttgagcccaggaggcagaggttgcagtgagccacaatcatgccactgcactccagcctgggtgacagaccaagactctgactcaaaaaaattaattaattaaataaaattaaataaataaataaaagaacaaaagtacaaggtctttaatcggaaaagctcagaactcatatcatattctgtgggtgatagtggtaccagatgaacaggttatatctttgcctctcctagacaattctggttgaaagctattttaaaaggaaatataaaaagtattcttttttaataaaaagaaattaccagtggatcctttatatttctttgcagtcacttttagacaggtaatttaataagctaaaagctgcactgaaaaagaactcattttgaggaaaagcccactatttgagatagataactcactatttgagatagatgatgcatttatgatttctcaaaattgggaatacagagtaaatctgggtaatggattgcaaggacttatacatgacatgtgaaagaaggggagatgacatttttctgaactgttacatcatattaaaaataccccaggcacggtggcttacacctgtaataccagcactttaggaagccaaggcaagaggattgcttgaggtcaggagttcaagacaagacctatttctaccaagaaaaaaaaaatgtgtgttaccaagagcaaaatatgaattgtgacccacccagataaggatgatgacaaagaagatggaagaacttgtaacttaataaaaataagcaggcggggcacagtggctcatgcctgtaatcccagcactttgggaagccaacacgggtggatcacctgaggtcaggagttcgagaccaacctggccaacatggcgaaaccccatctctactaaaaaaaaccaaaaaattagctgggcacggtggcaggcgcctgtaatcccagttacttgggaggctgacgcaggagaattgcttgaacctaggaggcagaggttgtagtgagttgagattgcatcattgcactccagcctgggcaacaaagcaagactctgtctcgaaataaataaattaaataagtaatataggccatctcatttgagaagataggaacaaagaaagcgaacaagtcaaatgtggtaagtctggagggaagctaattcacagaaagaacaaatggactaaaagacgtagttcctgggctaaggaaggtggttgatcaataatattaacttgggctgggtgcattggctcatgcctttaatcccagcactttgggaggccgaggagggcagatcacgaggtcaggagatccagaccatcctggccaacatggttaaaacctgttcttctaaaatacaaaaaaattagctgggcatggtgttacgcgcctgtagtcccagctactcgggagactgaggcaggggaatcacttgaacctgggaggcggagattgcagtgagccttgatagcatggctgcactccagcctggcgacaaagtgagactccgtctaaaaaaaaaaaaaaaaaaaaaattaacttgtaccaagtggttcctgaatactgggtttgctcaacatcagtgttagaagtagaaactacccaagattatacaaccagatttctaaaatagcatacttagacttagcgaggctgaggcaggtggatcacctgaggtcacgagttcaagactagcttagtcaacgtggtgaaagcccgtctctactaaaaataaaaaaataaaataaaaattagctgtgtgtggtggtgcatgcctatgatcctagctacttgggaggctgaggcacgagaatcgcttgaacctgagaggcagaggttgcagcctgggcgacagagcaagactccacccaaaataaaataaaaaaataaaatagcttacttagatatggatggcaaggttaagaatctgagctaagtgtcaatgccttttccaataaataaaatatgtgttaagtaagccaaaagaaaaaaagaaaaaaatggacttttattaaccttatggtttacttgactagatctctgtgggcaagtgaataagactaatatactaagaattgtgtagtggggtttttgttttctttttttgttttctagagacagagtcttgctatgttgcccaggctggtctgaaactcctggtctcaagcaatcctcctgtcttggcctcccaaagtgctggaattataggcatgagctactgtgcccggtcttgtacagtcatttaatatttaataaaatattatataaaataaaatagtctggcataacaccaacctaaaaaaaggttagcaacatcttgcttccaaaaagacatcttttgctattagaaataaaacaaagaaaaaacattcacaatatgaactcttagatcagagtatgcaccaaacattccgctagaaataaaaaaggataaatctgctgggccttttataacctgcactacatgtaacaagttactcacttgaagactacatcctcatcacatttctcttattagaaaagattggaggcatggcccctattgcactgttttatactttattttctgtttttctggttttatttttatttttaaatgacccaggccaggcgtggtggctcatgcctgtaatcccagcactttgggaggccgaggcaggcggatcacttgaggtcaggaatttaagaccagcctggccaacatggcgaaacctcgtctctactaaaaatagaaaaattaactgggcatggtggtgcatacctgtaatcccagctactcgggaggctgaagcaggagaatcgcttgaacccaggaggcagaggttgcagtgagtcaagatagcaccactgcactccaacctgggagacagagtccatctcaaaaaaaaaaaaaaaaaaaaaaaaagaccctacagtaaaaattgacaggggagaggggtgtaccttctatccatttcaacccacttacagccatgcgtggccatcaccgcaatcaggatacagaagagttccattctccccaataagctgtcctgtgcttttcctctctatatcacagggttttctttccatgtcgccatgggttttcgtccatgtcctttgccacctgagtttttctcccttcttcccagtcatttctgaccacttgagccttggaacaatcaggaatggagagtgcctctatcctaggagtgagaaaagggagagggaattagaggagaggtcttctgggttgtgggaatacaggaaccttattcagatcagatcatgaggtttccagccttctatctggaagagtctcatagccagttgggcatttaatttagctcaactaaaaatctctaataaaggtgagaggtattaagccatcaacagacattcacctgatgccgctggcaatagtggcttataattgtgggacagctcaaaactacagaaccagttgctttcagcatggagacaacgggtctaccattgtagaaaatgtggagaccacacattgacctcattagtaccaacatctagccatacacaggaatctgttttaatatcaccagattaactcacatcaaaacagttgctttgatttttagggtccattattattcctgttttactggaagctacaatgaagacttaagtgatggaagtgtcaacacaatagattcatgcctactaattcctgctgtagaacccctgagaccaagattagttttgaactgaagagttacaagtgggatgctaggtcctctcacagctcagtgaccacacacacaagcactcgtttcttctgaatcaactcttgtaactcttcagttccaaactaatcttttgtatcattcaattctactccagtatcaaaagcataattagaagatgtatttcacccagaactagagcagttgctattgacatttgtagcagtacagcttgtgctcggctccctgctctaattctagtgcaccaaaggggaatggtttctaattagagggagtagaactaacagagcatgaaaaacaggatatctgtgttgtagctgtaacatacctaagttatttagtgtctgcacttgactaataaaataagaaacagcctcccaaaatgctgggattacaggtgtgagccattgccaggcaggccaatcacctgaagtagagagttcgagaccagcctggccaataaggtgaaaccccatctctaccaaaaatacaaaaattagccaagcgtggtggcacatgcctgtaatcccagctacttgaaaggctgaggcaggagaatcgcttgaacccgggaggcagaggttacagtgagctgagattgtgccactccagcctgggtgacagagcgagactccatctcaaaaaacaataataataacattaataaaaataaaaacaaaataaaataagaaacaggctgggtgctgtgactcacacctgcaatcccaacacttcgggaagccaaggcaggtggataacttgaggccaggagttcaagaccagcctggccaacatagtgaaatcctgtctccactagaaatacaaaaattagccaggcatggtagcacatgcctgtaattccagctacttgggaggctgaggcatgagaatcactggaacctgggaggcagaggttacagtgagctgagactgttccactgcactccagcctgagcaacagagctagactctgtctcaaaaaaataataaaaaataaataaatttaaaggcctggcaccgtggctcatacctgtaatcccagcactttgagagaccgaggcgggtggatcatgaggtcaggagttcaagaccagcctggccaaggtggtgaaaccttgtctctactaaaaatgcaaaaattagccgggtgcagtggcaggcgcctgtaatcccggctactcgggaggctgaggcaggagaatcgcttgaacctggggggcggaagttgcaatgagctgagatcacaccactgcactccagcctgggcaatagagtgagactctgtctcagaaaaaaaaaaaaaaaattttaagaagaaacaacctaggtgacaatgttagttccagccacaatactccaattattaaaatcgaagttgaacaatgctgcctgtctattatggggaagggctagttataacattagtatgaagagctctctaatttaatgttttcattgtgtccaatctgttagatatttgtaaattgtctaatccagaaacctatgcactttcaaggtaactccatcccaaatctacttgactcaaaaaaatttttttttgtttttgagacagagtcttgctctgttgcccaggctgcactgcagtggtgtgatcacaactcactggagcttcaaactcctgggctcaagggatcctcccacttcagcctcctgagtagctgggacacaggcgcccgccaccaggccaagctaattttttttttttttttttttttttatttttttttgagacggagtttcgctctgtcgcccaggctggagcgcagtggcacgatctcgactcactgcaagctccgcctcccgggttcacgccattctcctgcctcagcctcccgagtagctgggactacaggcgcgcgccaccatgcctggctaatttttgtatttttagtagagacggggtttcaccgtgtcagccaggatggtctcgatctcctgacctcgtgatccgcccgtctcggcctcccaaagtgctgggattacaggcgtgagccaccgcgcccggcctaattttttgtatttttaatagagacgaggtttaagtatgtagcccaggctggtctcgaacacctgacctcaagtgatctgcccacctcagcctcctaaagtgctgggattataggcatgggccaccatacctggctgctcaaaatgttttcaccgatgcaggattttccccagtcagtatgaactaatattgctttcatactctgcctctcatttattctttctcctctagatataatctaaaggtttacaataaaatgtaacctctccaagggatagatcttggaattgaggggatccacttaaaaaaaaaaaagaatgtaaaaatgcaaataaaaaacgctagtgcctggcatagggccttgggaaatgaaatttaagcttctttagctttgtgataactcatttctgtctccaacatctggaaaacgttaaacatagtccattagctgtacaaaaacactgttattgagataagcatacacatgtgcgcacacacacgatttcacacatacatgcagggtccataagatgacaccagaggctgggcgtagtggctcacacctgtaatcccagcacttacggatgccgaggaaggtggattgcttgagctcaggagttggagaccagcctgggtgacatggagaaaccctgtctttagaaaaatacaaaaattagctagacatggtgtagtgcatttgtagtcttagttactctggaggctgaggtgggaggatggcttgagcccaggagttcaaggctgcagtgaaccaagatctcgccattgcactgtagcctgggaagatggccccagacattactcttcccattaaggttaaccccttgacttcctggtctccttcccttttctctcctcccctctatttattttgattgcctagaaccttggtgtagggaaggaggtggaattgctgggcttcttttccaatttttagttgtgttaagcatagggtaaattttaggaaaccatagtaatgtgcaaatacaggcactcaataaattaatggcaaattaattaaatgtataagtaaccatggaatccaatatatatttttttaacatgaacagtcctactaaacgaagaatcaaagacttttctgggggggggacagtcttgctcttgttgcccaggctgcagtgcaatgtcacaatctcagctcactacaacctccgcctcctgggttcaagcgattcttttgcctcagcctcctgagtagctgggattacaggcacctgccaccacacccagctaattttgtatcttaagtagaaacggagtttctccatgttggtcaggctggtctcgaattcccgacctcagatgatccacccgcctgggcctcccaatgtgctgggattacaggcgtgagccaccgtgcccagcccaaagactcttaaagatatattcaggcttgagaaatgtgttgaaacaaacaacacgacattcaatagggattgaatgtgatggcttggatttaggttttaaaaaactaagtaattggctgggcgcggtggctcatgcctgtaatcccagcactttgggaggccgaggcgggcggatcacgaggtcaggaaatcgagaccatcctggttaacaccgtgaaaccccgtctctaccaaaaatagaaaaaaattagccgggcgtggtggccggcgcctgtagtcccagctactctggaggctgaggcaggagaatggcgtgaacccgggaggcggagcttgcagtgagccgagatggcgccactgcactccagcctgggcgacagggagagacaccgtttcaaaaaacaaaaaacaaaaaactaagtaattgggccgggtgcggtggctcacgccagtaatcccgcactttgggagggagaccatcctggctaacacagtggaaacccgtctctactaaaaaaatacaaaaaaatttgccgggtgtggtggcgggcgcctgtagtcccagctcctcaggaggctaaggcaggagaatcacttgaccccgggaggcagaggttgcagtgagccgagatcacgccattgcactccagcctgggcgacagagcgagactctgtctcaaaaaaaaaaaagaaaaaaacccaaaactaattacatacaataaagggaatataattaatgttcaacagaagctttactaaaagccatgaacctggctcctgaaagaggcaatgtcctgaaaaaaaaaaaaaaaagtcaacaaacatcgataaactttaggagaaaaacacacagcaaatgacatattggtatgatgacaatgtactttacacatagatagctaggaaggatgagaacagcatatatttccaacaatcactgaagtaacagataaaaatttagagggttggagattaaacaaaaatgtgtaggtgctatagaaaaaatgcgttcccccaaaattcgtatgttgaaacctaatccccaatatgatggtttttgtagtacagggctttgggaggtgttacgtcatcagggtggaggtcttctgaatgggattagtgcctttacaaaagagttcccagagagctccctcacttcttcagtcatgtgaggacatagcaagaggacgaccatctgtgatccacagaggggccttcaccagacacaccttgatcttggacttagcctcctataaaaaataaatgtgttttttgtttttttttttgtgggtttttttttgtttgtttgagaaggagtctcactctgtagcccaggctggagtgcagtggcgcgatctccggtcactgcaagctccgcctctcaggttcacgccattctcctgcctcagcgtcccgagtagctgtgactagaggcgccggccaccacgcccggctaatttttttttttctttttttttcttttttttagagatgaggtttcaccgtgttagccaggatggtctcaatctcctgacctcatgatccgcccacctcggcctcccaaagtgctgggattacaggtgtgagccaccacaccgggccaaatgtttgttgtttataagccacccagtctatggcattttgttatggcagcccaagtggaaagatagtgtttctgatgttattataactcctgttagaaaaaggataaattatgtctgcattgcccttacctggttttgaaagcagagtggttatgatctgaaaaaggattacaggtgatgactttgaaagtaggctgaaggctaagattttaaagaaaagggcagtttactttatgccagtgtgtctgatgttatcattataactcctgttagcaataaggaaaaaggataaattatgtctgcattgcccttaacctgtttttttttgttgtttttttgtttgtttgtttttttgttttgaggcagagtttcactctgtcacccagagtagagtgcagtggcatgatctcagctcactgcaagctccacctcccgggttcacaccattctcctgcctcagcctcccgagtagctgggactacatgcgcccaccaccgtgcccggctaattttttgtattttcagtagagacggggtttcactgtgttagccaggatggtcttgatctcctgacctcgtgatccacccaccttggcctcccaaagtgctgggattacaggcatgagccaccgcgcccagctgcccttaacctggttttgaaagcagagtgattatgatctgaaaaagaattataggtggtggttttgaaagtaggctgaaggtcaagattttagagaaaagggcagtttattacttcaagtgtttttcataattgtcaataaacaaatatacataaaatacctccaaaaagataaatgcctaagtgttgcctctggggagaactagagaagtagggacacagaaatgtgtcctttaatgttgttgtatctttaatgtcatgtgaattttgtgccatgtttatgtatcatcaatttaacatttattaattttaaaaagtagaagacttgggcctggcgcggtggctcatgcctgtaatcccagcacttagggaggccgaggcgggtgaatcacgaggtcaggagatggagaccatcctggctaacatggtgaaaccctgcctctactaaaaatacaaaaaattagccaggcgtggtggcaggcgcttgtggtcccagcaactcgggaggctgaggcaggagactggcatgaacctgggaggaggagcttgcagtgagcctagatcgcgccactgcactccagcctgggcaacagagcgagactccatctcaaaaaaaaaaaaaaaaaaaaaaaaaaaaagtagaagacctggttcctactcttcctaagttaattgctccttttctgtgtacttgtactctctgggattattgctaatgtggcacttatctgaattcattgcaattatttaggcaagggaagagtttgtgaggttttcatgttggaaaaataacatcttcgccttttgtgaatggaaaatggattaacaagaggccagaatggatgcaggctgatcagttaagaggctattgcacctgcctaagtgagaagtgacagtagtttgggccaggcacagtggctcatgcctgtaatcccagcactctgggctaaggtgggaggattgcttgagcccaggagctccagaccagcctgggtgacatgatgagatcctgtctcttcaaaaaaatagaaaaaattagtggggtgttgtggtgtgtgcctgtagtcccagctacttgggaggctaaggtgggaggatcacctgagcccaggaggttgaggctgcagtgagccaagatcacaccactatactctagcctgggcgacagttagaccctgactcaaaaaaaaaaaaaggaaaaaaagaaaaaaaacacagttatttggactagaatagttgtgggaaagacagggagaaatgaaaaatttgggagatatttaaatgtctttgatattggaattgaggtaggaggaagttatcaaagataatacctgtttccagatttgggaatgtattagctgtgcatggattctttgggtcagatttgggagtggcttagctgaatagttctttttcagggtttctcatgagatttcagtcaaagtattggcctgggctacagccatctgaaggcttgactgtggttgggggatcctgctaccaaacccacttacattactgttggcaggagacctcagttccatgcagtccctgtggacctctccatgggacttcctggatctcctcataaattgttagctgtcatacagaaatctgatgtttgctgaattaatgttttttaaaaacctagccatttctgctagggacagtggatcatgcctgtaatcccagcactttgggaggccgaagtgggtggaccacctgcgctcaggagttggagagcagcctgggcaggatggcaaaactctatctctacaaaaaatacaaaagttagccaggtgtggtggtgcacacctatagttccagctacttgggaggctgaggtaagaggattgcttgagcctggaggttgaggctccagtgagccatgttcgcacctagcagaaatggttaggtttttaagaaacatttaaaaaatgtttagcctgggagacagagtgagaccctgtctcaaaaacaaaacaaaacacaacaaaaaacctgaccgtcatttcaaccaggcagaattatacatttatgcatccatcaatctttcattccttgattgattacatcattatttcatatatattatgtgccatgcaatgttctaggtgctgggcacaatatttgtagggtccttttctcaataaacttacattccagtgagcagagacagataaaaatcaggtaaatgaatgacaaagataattttgtctagtaattaatactgtaaagaaaaacagtataattgaataaagtgatgggggatactacattagctaaggccattaggcaaggattttctgaggtgacatttgcgtttacacggcaaggagaggccagccccacaaacatttgcagaacaagatttccaaacagtgggagcagcaagtgaaaaagcctgaaggatggatgagttaggtgtgtttgtgaaataaaatgaaagccagtgtgatcagtgcataatgaaaaggaagaccaaagccaaatcttgtaggactttatcaactttgatagagaagctcgattttatttcaaccacatggaagtcactggaggtttttaagcatgaataatgatacaatctggtttgccataattaaaatatccatagtgggccaggcatggtggctcacacctgtaatctcagaactttggaaggctgaggcaggaggattgcttcaggccaggagttcaagagcagcctgggcaacatagtgagaccctatctccagacaataattgaaaaattagctgggtgtggtgttgcacacctgtggtctcagctactcgggaggctgagttaggaggatcacttgagcctgggaggtcaaggctgcagtgagcctgattgtgccattgcaacacagcaagattctgtctcagaaacaaaacaaaacaacaaatgaaatagccatactgctataggaacaaggaggtataattgttggctagggctgctataacaaaatgccacagactgggtggattaaagaatagaaatttatccaggcacagtggctcatgcctataatcccagcatttcgggaggccaaggcaggtgaatcacttgaggtcaggaattcgagaccagcctggccaacatggtgaaacctgtctctaccaaaaaaatacaaaaattagctgggtgtggtggtgcacgcctatagtcccagatactctggagtctgagatgggagaattgattgtacctgggaggtggaggttgcagtgagctaagatcacaccactgcactccagcctgggtgacagagtgagaccttgtctaaaaaaataaaataaaataaacagaaattaattttgtcacagttctggaggctgggagtccaagatcaagatgctggtagggttggtttcctctgagggcctaagggaggagtctgttgcaggcctctctccttggcttgcagattgccaccctcttggttgctgcctcttcacacatttgtctctgtgtgcatgcatccctcgtatccccctcttataattacaccagtcatatgggattaaggtcctatcccgatggcctcattttaacttaatcatatctttaatgacctaatctccggatatggttacattctgaggtactagaggttgagacttagagaagtgaatttgggagagacacataacagcccataacagaagtcaagaatggaagtagcaagatcagttaggatactactgcagtatctcagcaagagatgccagtggcttggattaggatttttagattaggagttgttggattagataattattttaaaagtagcatgcatgggtttgctgcttctaagtgctaaaaataaatgactcagggattatcatcagtttttggcctgagcaacttggttgccatttgctgaaacagagaaaatggagaagcaagtttacagggagaacaagaattatgagattaaatgattctttaagaatcactcttctcttatgagaagattttttttttttttgattcgggttctggttctgttgcccaactggagtgcagtggtacaattgtggctcactgcagcctcaaactcctggcctcaagtacttctcctgtcctagcttcccaagtagttggaactacaggtgtgcaccaccacgcctaactaagattttctattcattctttttatagagatggagtctcactatgttgcccaggctggtctcaaactcctggcctcaagccatcctctgccttggtctcccaaaatgctgggattacaggtgtaagccattgcacccagccaataattctaatttgaacatattatgtctaaaacatattagacattcaggccaggcgtggtggctcacgcctgtaataccaacactttgggatgccgagacgggtggatcacttgaggtcaggagttccagaccagcctggccaacatggtgaaaactggtctctactaaaagtgaaaaaattagctgggcgtggtgtggcatgtgcctgcaatcccagctaccagggaggctgaggcaggagaatcacttgactctgggaggcagaggttgcagtgagctgagatcgcatcattgcactccagcctgatatattgctattaatttccaaaaaacttttcatggtctctgattcaattcctacacagcacaaactcatagcctactgtccagagattgggagtgtggtagaagaggagtcactgctcaactgtacaagggtctatgtgtagagaagaacctgaaggcctcattactccttgtataaactcacaaccaaatcctatttcagctcctattttctggtacctacttttaccaggactcttagaggttcttcaaagtaaatcaaattgcttctcactggtcttcccttctgcaccctatgtctactattaactatcattcttttagtcttacaaaaatttgttgaactctcgtctgctggaactctgctttcagcgaagatggaaagaccagaactggatttatccttctgcctaaaacaactagaaaaccagacagagtacataaaacaatggttttcagatggtagataatgggcagtgcaggactgtgatccccgagcaaagggaaaacagaggtgactcctacaattgagccagcttactgtctggagggagttttcaggctccagtgcaggtaaagggaacccagacagagcatggctctctggctaagttgaggagatagataccagagttcacagaggccactagaattttcaggacagactgcaagagaagacagagctctatagagagaggtctagagacttggaaaatgagtttcctcaagtctatggctgagttttgggctgtgcatgcacgagaagaacatgactggggccagagaaataatctctggaaaggagtagacagaaaaaaatcctagacctcacacagggctggaaataaattattcatgttctcaaaagtcacagtattatacagggcatgaggcagaatcttcaaaaggttgttgcctgagttgtgaaatcaaaatagatcaagattaaaggccgttctttacttacaccaataatcttaaaataaaattttaaaaggatctaactgatttcaagtacttaactgcacactacataaaagaattcaggccaggcgtggtggctcacgtctgtaatcccagtactttgggaggccaaggcaggcagatcacaaggtcaggagatggagaccatcctggccaacatgatgaaacccagtctctactaaaaatacaaaaattggctggccggcatgtgtaatctcagctactctggaggttgaggcaggagaatggcttgaatccgggaggtggagatagcagtgagctgagaccgagccactgcactcaagcctggagacagagcaagactccatctcaaaaaaaaaaaaaaaaaaaaaaagaattcagcggccaggtgcggtggctcacttctgtaatcccagcattttgggagcccgaggtgggtggatcacctgaagtcaggagttcgtgaccagcctggccaacatggtgaaatcctgtctctactaaaaatacaaaaaaactagccaggcgtagtggtatgtgcctgtaatcccagctactcgggaggctggggcagtagaattgcttgaacctgggaggtggaggttgcagtgagccgatatcacgctactgcactccagcctgggtgacaagagcaagactctgcctcaaaaaaaaaaaaaaaaaaaaaaaaaaaaaaaattccgcaagatccagtaactagcaatgtgaaattcacaacatctggcatctacgaaaaattaccaagaatgcaaagaaacaacaaaatataattcataatcaggagaaaaatagaaaaatcaatcaataggaacaaactcagaaataatagatatgatgaatctagcagacaagtttttcttttttatttttttgagacggagtttcgctctgtcacccaggctggaatgcagtggcacgatctcagcttgctgcaacctctccctcccaggttcaagtgattctcctgcatcaggcccctgagaagctgggattacaggcgcccaccacacccagctaatttttgtattttttgttattttttaaattattattattatatttatttattttttgagacagagtctcactctgtcgctcaggctggagtgcagtggcatgatctcagctcactgcaagctccatctcctggattcacgccattctcctgcctcagcctcccgagtagctgggactacaggtgcccgccaccacacctggctaatttttgggttttttttttttggtatctttagttgagacggggtttcactgtgttagccaggatggtctcgatctcctgacctcgtgatccgcctgcctcggcctcccaaagtgctgggattacaagtgtgagccaccgcacctggccccgtattttttctttttcttttagtagagacagtgtttccccatgttggccaggatagtctggaactcccgacctcaagtgattctccctacctcggcctcctcaagtgctgggattacaggtgtgaggcaccgcccccagctgcattcaagtgtttttgttgttgttttttgtttttttgagacagtcttgctcttgtcacccaggctggagtgctatggcacaatcttagcttactgcaacttctgcctcccaggttccagcgattctcctgcctcagcctcccgagtagctgggattacaggcgcccgccaccacacctggctaatttttgtatttttagtagagacagggtttcgctatgttggccaggctggtctcgaactcctgacttcatgatctgtccgcctcggcctcccaaagtgctgggattacaggcatgagccaccgcgcctggcccgcagacaagtttttaaaaatagattttataaatatacactatatgttcacaaaagtagaggaaaacatgagcatggtgaggagagagaaaatatttttaaagtcccaaatagaacttccagaaatgaaaatgcaaggtctgaaataaaaaatacattggatggaatttaaagatcagatgctgcagaagaaaacatcaatgaatttgacgacaccaatatagaaactatctaaaatggagcacaaagaagctgggtgcagtggctcaagcctgtaatcccagcactttgggaggccgaggtgggcagatcacctgaggtcagaagttcgagaccagcctggccgatatggcaaaaccccatctctactaaaaatacaaaaattagctggatgtgatgatgtgcgcctttaatcccaactactcgggaggctgaggcaggagaatcacttgaacccaggaggcaggagattctcttgaacccaggaagcagaggttgcagtgagccgaggtcatgctactgcatgccagcctgggcaacacagcaagattctgtctaaaaaataaaataaaaataaaatggagcacaaagagaaaacaaggccaggtgcagtggctcacacctgtaatcccagcactttgggaggcggaggcgggcggatagcgaggttaggaattcaagaccagcctggcaaacataatgaaaccccgtctctactaaaacacaaaaatttagccaggcatgctggcaggcgcctgtaatcccagctactcgggaggctgaggcaggaaaatcgcttgaacctgggaggcagaggttgcagtgagctgagatcgcgccactacactctagcctgggtgacagagcaatactccatctcaaaagaaaatattaacaagggagataaattaattaatctaaatgttggttctggctgggtgtggtggctcacacctgtaaactcagcactttgggaggccaaggcatgaggatcacttgagcccacgagtttgagacctgcctgggcaacatagtgacacccccatcactacaaaaaaatacaaaaattagctgggtgtggcacacacttgtagttctagctactagggggactgaggcagaaggatgggttgaacctgggaggctgaggctgaagtgagccgagattgcgccactgcactccagcctgcatgacaaagtgagacctggtctcaaaaaatataataaaataataaataaatgttgattctttgaagagagcaataaaattgataaaaactgaaacagggaaagagaaaagataaaaattaccaagatttggcttgaaagatgatatcactacagatctgatagacattaaaggataaaaaaaaatattatgggccgggcacagcggttcacacctgtaatcccagcactttgggaggccgaggtgggcagataacctgaggtcaggagtttgagactaggctggccaacatggtgaaactctgtctctactaaaaatacaaaaattagccaggtgtggtggcaggcgcctgtaatcccagctactccggaggctgaggcacaagaattccttgaacctgggaggtggaggttgtgtagcaagctgagatcatgccactgcactccagcctgggcgacggagccagactccatctcaaaaaaaaaattatgaacaattttatgacaataaatttgacaatggagacaaaatagagaaattctctgaaaggcataaactacaaaacttactcttttttagtaagaaatagataagctgaaaagatctatatctattgtttctctctgatgatgtttaatttcacagtaatgtacccagctgtggcttttttttgtgatctcgtttaaccctctttgaatcctttcaatctgaaattttccttatttatgatgtaagaatatgacttttgggggatttaaaaaacattatgtcaagtatttagtaaatgttcagtactcagtaaatattagatgctctggctgggcatggtggctcaagcctgtaatcccagcattttgggaggccaatgcaggcagatcacaaggtcaagagattgagaccatcctggtgaaaacccatctctactaaaaatacaaaagaatagctgggcgtggtggcgcacgcctgtagtcccagctacccgggaggctgaggtgggagaatcgcttaaacctgggaggtagaggttgcagtgagtcgagactgtgccactgcactccagcctgggcgacagggtgagattccgtctcaaaaaaaaaaaaaaagttagccagggctgatttccagcttgttttggatataaacatccagaagagacatttcttccacccttacaatgaaaaaaaaggtaaacttccttcaaattacagagtatttttgaatttatcgaagagttgagttcccaggacaaaaaactggtccaaaatctaagaagcaacagatgcctgcaggaagagaagggcactagcttacttgggacagacacaaccagatactggtatatgtttagctagaagaattgcggaattcacgaaggctggtgtggactggcagagcactcaactctgttgctcaggctggagtgcagtggtatgatcttggctcactgcagcctagtctatctcacaggctcaatcctcccacctcagctctcgagtattgggactatagatgagtgccaccatgcctggcattttattttttgtagagacaaggtctcactatgtttcccagtctggtcttgaactcctgagctcaagcaattctcctgcctcagcctcacaaagtgttggaattacaggcgtgagtcactgcaactggctttttttttttttttaactgctgtaaaaggcaactatcgaaagcaaaaatagcacaagtattgtatgtttacagcatttgtaaaagtgaaatatatggcaacattggcacaatgaatagaagagttgggaatatactgttttaaagtccttctgctacatgtgagtggtgtattactgaaggttcctattatgtggaacctatttgactggaccattccatgaaagttgtaggcatgaaagaataaaagtgttacagaaatatgtgaccttgaattctaaaattacactgcattacatgtatttttataacaagtatgctcttatgctttaaaaaactgtctttgttttcttaatagacttgatttttttcagaacaattttaggtgcacagcaaaaacgagcagaaagtacacagttcctttcatcccctcccccatatatgcacagcctccctatcaacatcctgcaccagcatgttctacttgttagaactgatgaacctacattgacacatcataatcatccaaagtgcatacattaggcttcattctcagtgatgtacattcaatgggttttgacaaatgtgtaatagcatgcatccaccattatagtatcatgcagaatagtttcactgcccaaaaaatcctgtgcactccccttggtcattctaaattttcatttctctgaagctagaaatcccaaagttagagttggcctttttcattctaaagtatgtcttcaattctgggaaattctcagcaataattctttcacatgttctttttttccccttctggaatttccattagaaaaatatttatgcttctaccttccacatttcttaactctcctttcatgctttccatttcttagttccttccttgctctaatcttccggttcatgagtgaactgtccagctatattcaacccatccattgagttatttcattaatatttgtcaacatccaattcacaaatgcttgtttgtgctttgtgtttccaacattctcccttctttctctgaagctctattaagcttattttcaattcttattgtctgatccattcacttgactttctctggtatagctagttctacgtattgttttagcagttctcatggtcctcagatgtttcatgattttccctctgtgctcattgctcatacttattccttgggacaatcagctgccttggcgatcatgtctacctgagggaaagggagaaaagcctcaatgttggtttgtgctgctccacaagagtttaggacttgggaaaaaggtatatctcatgtcaaagtgcttccaggataatgatccagttaaagcattccctgttttcccatttcaggcatgtccagatcatttcacaattcctctactccagccactgctactgatggagaggtaaagggaaagaatagggggacaatggggtccccaggcacaggctggccaatccacactcacacaccacacttccaaatgtcttggctggttctttttttctgacctactccttaaaggttgatgttttccaatgctccttgcgtgttccttttatctaacattggatggagtctctctggctcacattttcttcacctacacatagcagccgaacaaataacattcaaagtttgttaaataattgtgtaactgggaaattcaagggacattttcaaccacattctcaatcttggaggaggtaaggctcagtttcagcttcaaagtacctgttttcattggttcagttattttatcttaaaaaggaggtaaatactaaacaaagttagaaaaagaattctaaaggtccaactctctatttctgtggatctccatttgcactgtggagttgcttgagccatataattttaccatgtttatctctggtggatgtcagttaatattaagtgggttatggactaattttagctctctgtgaaaatcaacacacccagattttaaaacaaatattttggtactcatatctaggtatactataatttttagggaggttttaaaattaattttatttatttatttatttatttatttatttatttatttatttatttatagagacagggtctcactctgttatccaggttacagtccagtggtgcaaactcctagacccaagggatcctcctgcctcagccttccgcctagctgggactacagacatgctaccacatctggctcatttttcttttttttggtaaagatgggatttcactatgttgcccaggctgatctcgaactcctggcttcaagcagtcatcccacttcggcctcctacctcaacctgtgttgagattataggcacaggccaccttgcccagctcagggaggttattttttgaaactcttttcctcagactatattgctctcctaagccagtctgaggttactcttttggctccacacattaatatttatttcttattcttaccttttcagaacatggcaaaaaaacgtttggccccaatttctttgcacagcctagtatccagaaagagagaaaactgatcatctatggggactgcatgtattatcaagctatggtattcagatttattttatcatttaaatgatcatttccaaattttgtatactaaaaactcagatatagaagtccctgagtgaatctgtacacagaaaggcttagacacaaataccaaattaattgtcatgccaggctgggcacagtggctcatgcttatgatttcagctactaaggaggctgagttggaggatcgcttgagcctgggaggtggaggttgcagtaaactgagattgcaccactgcactccagcctgggtgacagagggagacctttctcaataaataaataacataaaatataaattgtcatacctgggtgttgggatggctgggttttctagtctctgttataaaaaggttacattttatttgaagaaaacaaagtatccacatgatggcactataacctacaaaataagaggttgtcaatttatgaagaccaagaacttggtaaattctacttagagtacttactactctaaaatgctgaaaggaaattgcctaaagaatgtgctgaaaaatggctgggctcatgcgtgtgaaatctcagcaatttgagaggccaaggcaggcagattgcttgagctcaggagttcgagaccagcctgggtgacatggtggaaaccccctctacgaaaaatacaaaaattagcctggcatggtgatgcacacccgtagtcccagctactcgggaggctgtagtgggaggactgcttgagcccaggaggttgagactgcagcgagccaagatcatgccactgcaatccagcctgggccatagagtaagagatcctgtctcaaaaaaacaacaaaaaaaagaatgctgaaaaataaggcattttatatacaaggtaatatggatataattcccttatgttttatagagacttactggctaatccttcatatccctttctaagttcatttttccatgatttatttaataacagtatcttagtcctagtgtgagcacatgaccatgttgggagctacttaacgcattccccataatgtcatgtcttcctataggcgattctagcaggcaattcaggagctattagagaaagagtgttaactgagacaaatgccatccatggagtttatattctggccggaagataggctttatttatttatttttttgggatggagtctcactcactctgtcgcccaggctggagtgctgtggcgcgatctcagctcactgcaacccccgcctcacaggctcaattgattctcctgcctcagcctcccaagtagcagcaactataggcacaccatcacgcccagctgattttttgtatttttagtagagatggggtttcgccatgttggccaggctgtatgatatgcactgtattaaaacctttatgttattagctaatgtattcttcttcacaaacactttatgcagtactaggatccctgttctacagctaaagaaaactaggctgagagaggcgctaaggccacagaacaaaaatgtggcatggagcccttttccaatatgaaatatattgacaataacaatcttcctcttttcctcatgcctttcttctcccttaatgaggcatggtggcacatgtctgtagttccagctacttagccagctgaggtgggaggattgcttgagcccgggaggtcgaggctacagtgaaccatgatcgcactactgtactccagcctaggtgacagagtaagaccctgtctcaaaaaaaaaaaaaaaaataaaaattagtttagtttaacgactgcaatcttatagttttaaataattcaggagcttgggtttttattataatatcctttagtgatagttttaagtagtttcctgagtacacagcacatcagatttagaggtttaagtttaccaaactcaaaaaccaaaagcacgtaaacacacatacacaatggtatttcccatgttggaacacagaactgttaactctctaatagaatgaaacattttttgccaaatggcaaatcaaagacatcataaatcaagcacatattatacttacttgtttttacctttctcatatatttaaattgggcacactatctttgtaagtctcaaatcctaaagtttgaatagaaacggcctgcatagaaatgcttttaaggtgaatcaattttctagtttttctctgtattaaattagtaaaataaaataggatagtcatttgaaaaatgctaaatcttgagatctgtggtctagtagaaagagtacagggttaaaagttacaacttcagggttatagtcctaatattactatctactagccaaaggacgttttgaaacctctcagcctctactttctaatttataaaacaaaggggtttattttgacttctaagttctcagatttcacacaagtcaacaaacaaacttggccaagtcataaaataataattatagtttacatttatttaatgcttattttgtgccaggcacaatgttctatatactttacatgtattaatttaattcatgtaacttgtgaggcaggtagtaataatatccttattttattttattttatttatttatttttttgagctagagtcttgctccatggcccaggctggagtgcagtggcacaatcttggctcactgcaacctccaccccctgggttcaagtggttctcatgcctcgggctcttaagtagctgggattacaggcatgcgccaccatgcccagcttatttttgtatttttagtagagatggggttttgccatattagccaggctgtttgttctcaaactcctcacctcaagtgatctgctcacctcagcctcccaatgtgctagaattataggcgtgggccactgtgcctggccaatatccccattttagagaacccatctatataaaaaaattaaaaaaattagccaggcatggtggtgcacacctgtagtcctagctactcaggaggctgaggtgggaggattgcttgagcctgggaggtcaagactgcagtgagctgtgacggcaccactgcactccagccagggtgacagagtgagatccgatctacaaacaagcaaaacataacaaaaaacaaaacaaaacaaaacaaaggacttcatgccaaacttagttacactctgtcagctaataacatctcactggtgtttctgcttcaattaaaatgtcatttatttttaaaatatataaagcattcttgcagtacacaattcaagaggccaccaaagataattcacagtctcctttcacttctgttccttaagtttcagtccctcctagtcactgtagattttctaagagaaatcacatcaccagagctgtatctaaggaaaatgaatcagacagaaatacttaggatgaactataatggaagtaccagatgggtaatagtgggaataaaaaaaaaagggatggatgcaagtttctacaggcaaaagcaacaggacttagcatttagcatagggcctggaacatagcaggcacttcaaaatattttctatgtggctcctgaatgacatgagtagaagaatgaccaaaatcgtttcaaggtgtagaggcaggatgacaaggagctgaaaagtgccattaacattgctaaaacaacaataaaaaatcaagattcaggtatgaaaggggaagaagacaagacatgtagttttgaacctatgagttggaaatgctcatgggccatgtaagtgagaactgtcaggtgtttggaaatgtgacctggtgctaatgaatgaagttggaagctttgggtataaattttagaattatctttcaaaaaaattgggtatgattagataactaaagaaaatactgtttgaggacagtatagaagatgatgtccaaggacagaaaattagtaactgtctacattagggagacaaagatgagtgaaaccatgagagccaagtatcatgaaaattcaggagggagactatgttaagaaagtggcaggcttatgcctgtaatcccaacactttgggaagccgaggtgggaggatcgctttagactaggtacttgaagctgaatgagctatgattgcaccactgtactctaacctgggtgacagagcgagactctgcctctaagtaaatacatttaaaaaataaggcagtagtcattggtagtatctgatgaggaaaataggtcaagtagaatgaaaaatgagaaaaagtggtcagatttagtcatcagaaaggcgacagacaagtgcaatggctcatgcctataatcccagcactttcagaggctaaggtggaaggattgcttaagcccaggagttccagactagcctggacaagagactccatgtctacatataaaaataaaaattaaattaaaaaaaaaagagacggaagagggcaaaaatttggcaggaaataacaaacaaatgggtggtgaagaagtgaatacaacccctgccttgccttcttctcttgagaaatctgaaggtgaggggatggcaagggatggaacagtaagcaaatgggcaaaaaatgaaatgtaaatgtgcaacccggaattggcaactctgtggccttccttatagggctagcagtgccaacagttttcaagaggcacgatactaacacatttgtagggaaaggagccaagaggacgaaaaaggctgtaggtatgactcttggtaattgagcaagatctgatatgggaaagaaatgacatctaacttacagttggattcggagaggaaaaagaggtgctcctcccgacccagaaagggagggaaagtttaagatattttgaagtgaggagggaatataagggtgtgactgacagcccgtattttctcagaaaagtaggtgacctagttgtccctccccaacagagaattaactatcacctaggtgaggagccccaaaagctagacactggactaacgtaaacatgagtaggtttttaagtatttatcttatggcagatattttttaaaatctacaataatcctaacaggtaggtactatttttcttcccatttaaaaaccttatgcttcccctaagaggatatgacacttgcccacagctaacaagcatacatttaaacccagatccaactgcatggtttttaagtctattacatcttacagcaagggtatagcagaggccatgaactgatgggcttgtaagtatgtgtatctcacctccagtattgatctttgtaaaaaaacagatgaacaaaaaaatatggtttgtgctttctgaactttataattaagactacatacatatgggagtaaaatactggcaagaaaggaaaccgtagagcaaatactttgcaaataagaaattgccattcctttgattctttttgattcatatgaactcctgttacagagacaattgttgtggatacattccctttgacctacgaaaattagatttgaacaaaggttcagattggatttagattaagtcctgctcagtgaaaattatgaaaacactctgacactacagtaactgatatgaaataataaatcctcacttaacattgtcaatagcttcttagaaactggttttcagtgaaacaacgtacaatgaaaccgatttttgttatcatcaatattataacgaaatgaaaacaacactgaatgaaaatttttttgtggacctgctgtaagttgtttggcttaaagccatgatttctaagaacctatcgttaagtgaggacctactgtactctataaccatgctgctattctttattcctgatatcccattactttttttatttttgagatggagcctcgctctgtcacccagactggagtgcagtggaacgatctcagctcactgcagccttgacctcccaggttcaagcgattctcctgcctcagcctcccaactagctgggactacaggcgtctgccaccactcctagctaatttttgtatttttagtagagatggggtttcaccatgttggccaggctgctcctgacctcaggtgatctgcccatgtctgcctcccaaaatgctgggattacaggcgtgagcccccggccgacctttctaatctaaaaaaaaaaaaagagatgaagtctcactgtgttccctaggctggtctcctgggctcaagcgatcctcccaccttggcctcccgaagtgttgggattacaggcccgagccagcgggcccagcatgcggaccatttccagtcaaatactgggataaactgcaataaatgaccctaagaagcaggtgaattgtctcaggagctcaagcttcttttggagaaggactcaaccagctgtgactggctgtgaatatggaggaaaagggccactagtcaaggtatgtagatagcttttagaagtcagaagaagcacgcctgcagtcccagctactcaggaggctgaggccggaggatcgcttgagcctggggagatagaggttgcagagagccgagaccacgccactgcagcccagcctggacagaggtgagacgctcgcggaccttagcttggggttggcggcgttaggaagaaaccgacctcgagaccctgaagacctgacaacagccgttactctggctgacaagtcattggatttctggcgcacgcgcggcgcggcacgggcagcttccggtttccagccttgcccccgcccctaccttccgccccacctccaggctagttcctcctcttggccccgccccctgaccttccttctccctatccctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtaagtggtgcgtcggctccggccccgagacccagcagcgggcgacgcggcgcaggaggtggaggtggaggcaggaggcggagcggagccgggtgcggtggagcagcagaggccgagcggagccgtgggcggcgggccgggaccccggggccgggccaaggactggcggggcagccgcgagttcacctgacgcggcccctcgctcggcgcccccgaggccgccggctcgccgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagtaaggacctcggatttgagtgcccccagcgcctctgccccactttacgagcgcagtttagacgaaagcggacgcagcccgttttcccccaaaacctgggccggagggcctcgcagctgagtcattcggtcccgggcgcgggcagtctccggagtgggaagggcagagccgcgaccgctctcggaaggcgcattttcccttctgcctgagtcttgcctttttagggccatctggtaaggtttccagagcctgttgaatctggggaataaacacattattaaacatactttttttttttgagacggagtcttgctgttacccaggctggaatgcaggggcatgatctcggctcactgcagcctctgcctcctgggttcaagcgattctcttgcctcagcctcccgagtagctgggattacaggcatgcgccaccacgcctgctaatttttgtatttttagtagagatggggttttaccatgttggtcaggctggtctcgaactcctgaccttccacccacctcggcctcccaaagtgctgggattacaggcgtgagccgccgcgcctggcctcagcatgtttcttgatcctgttgcgttttatttgtatatcagatacctgagtttgaaatcacttaggggtttcctgcatgctgctcagtgaagcagcggtgagtttgtaatcacattttaagaaattgggacttacagggccagtctcaaagtgtcactgaaattgaaagagctcctttaacactgtggcttacgtacgtgactcagtttcctttctacttaatttgccgggcagatgagggtgtacctttcccttgaaacaaagatctagattgaacagtgagaggtccgctgtgaacattgcatcagattacatgaataaaccacgctgttttttatttgttgtttttttgttttttgctttgagcgccacgtttttttcctagtctttttttttttttttttgagacggggtctcgctctgtcgcccaggctggagtgcagtggtccgctctcagctcactgcaagctccgcctcctgggttcacgccattctcctgcctcagcctcctgagtagctgggactacaggcgcccgccaccacgcctggctaattttttgtatttttagtagaaacggggtttcacagtgttagccaggatggtctcgatctcctgacctcgtgatccgcccgcgtcggcctcccaaagtgctgggattacaggcatgagccaccgctcccggcctttttttcctagtcttgattctttttttggataaactttcccttcctaagtcatagtagtcttaaagtctttcaatctaaagtaatttttttcccaaaggaaggcaaattgcacacaatatgttttggccaataaatgctaagtattaaaactgatgtttaaagaactatgtattgatcccaacacagctttaacaaatatattaaaatggttttgatcctgaatgagtaaacacttaaagcattgtcagtattcacacaactttggcgaatctgtaaatagatgaatataacacttactttcccagtgaattggtgatggatatggaatcattttggtgattgcgaagttgtaattacggtgatgttttgtgtacatattttggtgacagtatatgaataaatttttattgaatgcgtaaacataggacatttttatttttagtctttttgtttttgcattgtccctgaaagttaatgaaatttacttcttcttcctgaattttaaactctggaatccatagttaataggctgtattccagtttcctactcaggtgagtcactgcctaatcaaaatacaaaatcttgcttagggttatgaccatttcatgaaaagtagggaagagttttgaattattaacatatataaggaatcctgactgaatctttaccaacatagacatatatttctgatcctttttctcccaagttgtattccctgcaaattaagtattgggccagaagattgagctaggtttattgtttaagtggatgttcttactgaaaagctctcaaatgtcctgttccttttagatagacttcttaaaataaaactgaacagtgcaaacacttaatagctgaacgattgagagacgttattttttagagcagttttacaaccattgatatttttatatttccttaccaacattgattgataaggaaataagcctgaaataccgaattttattgtttctacttaagtaaatggatggattccatatgtaaaagtcagctttgaaaatagttattattgtacattgaatacagttttgatattatcaacacaggaacttaaaaatccagtttaggccgggcatggtggctcacgcctgtaatcccagcattttgggaggctgaggcaggcggatcgcctgaggtcaggagttcaagaccagcctaaccaacatgaagaaaccccgtctctactaaaaatacaaaattagccgggcatggtggcccatgcctgtaattgtggctacttgggaggctgagactggagaattgcttgaaccccggaggcggagggtgcagtgagccaagatcaagccattgcattccagcctgggcaacaagagccaaactcagtctcaaaaaaaaaaaaaaaaaaaaaaattttttttggaaaaatgtatctcattacacaataggtagaaatgaacattttaaataattatgttaataatctccttttagacaatacattttaaatgtcttttgcaatgggaactccacaataaagactgtgctgttcttaagaataaatgcttttactcataggttttcattttctgatactgtatatccagtagagaataagcaagaacaaagaagaaaacctaaggatatcattagtggaaatttttcttgatactacttatggaaatgccttaagtcttactgcactgaataatgatgttttgttcaatgatggaccacatatatcccataagattataatggagctgaagaattcctgttacctagttatgtcctagctgtcctaatgtcagagggcagagtattaccttttctatgtttaggtatgtttagacacacaaatacattccactgtgttctaatcgtctgcagtatatagtacagtaacatgctgtacaggttttgtagcctaggagcaacaggctatcccatttggcataggtgtgtagtcggttgtgccatctaggtttgtttaagagcagtttacaatgttcgcagaatgaagttgcctaatatttctaagaatgtatccccattattaagtgaagcataactaattcagttatagcaaggtttacaaagtaaaatgatatctatttgcacatttcatgacaggccttcctaggagtgatagaggaaattactggcaacgtgtgtgtgaagtagtttttataagtagaggaaatgcataggctataaaactatatggtagttttgcttaaagactgcttaaataaccatctcgttggtcaggaaggatgcttacctctaagaaaaccttactagcaactcatcctcttgtcagacttttttgaagcctctcagatctccacaaatgagaaacatctttgtgcatgttttctaaacagtagtataaccaggccatttaaatatcaagatactaataaaatcctgtgaacgtttaagagtggagctaatgtgatgctaatattttccctgagaatttcacaaaataaactcagtgtctttaaagttatcttagtaaaggtttttttttgtgtgtttttttaaacatagcagacttaaatcatccaacttagaatagcaaaatagcagatagttttgtttatattcttaatctcaatttttttattgatagcacaaaaaatgatttttttttggcttagaaatgtttttaactggaatttatatcttagcactgattatggtgaaagtatccactttggaattatgacaactgtatcacacataaagacccacattactgaatatgggtgcttggaatgtttttactcttaaaatttctggaggagtaaaattaggcatgtttctgcacttagaaagatacaggttttgttcagatgtgtaagataggaccaatctaggtaagtaaaataatggtaaaattcttttttctgatcttaagctaattcaggtagtttatctcctttgtcagatttactatctagtagttaatacatttatacttaatacgtagatatgtgttttcagatgtacttaatgtgcagtaaagaagcatgctattgaaaacaaaacaaaacaaccttacagtgattctagtcaagcaagtaactccttcaaaagtttaaaaatttggtttcacattggccgggtgcggtggctcacgcctgtaatcccagtgctttgggaggccgaggcgggcaaatcaggagaccagcctgaccaaacatggtgaaaccccgtctctactaaaaatacaaaaattagctgggcatggtggctcgcgcgtgtaatcccagctactcaggagactgaggcaggagaatcgcttgaacccgggagttggaggttgcagtgagccgagatcgtgctactgcactccatcctgggtgatagagcgagacttgagtctcaaaaaaaaaaaaaaaagaaaaaaaaattggtttcacatgaagtggtggtggcgggggagggaggtgtttgaaaggatggagacaggccatgattatttgaatttcacttttcatttcctcctcagcagcccattctgtagttcatttactgtgaaatggccaaaagcaggcagcatgtgggaaatgaattgaaaaagagacacttactgaatagctagtcctttagtgattttagtaaagagttaagattacttaaataataacaggtgtctcaggcaattaaattggagtagccgtgaatctatattagagagcctcgtgaatttatgtataattcatgtttgaaatattaaagacatttacaagtgtttggaatatttatttacgagtatccctcttggctattctgtttttacatgaaagcgtaaagattattttttgaaagttactgttactttgcttcataaagagtataagaccaatggtgtaatttcatggtactgctttctcccattgtttttcctgtactcatcttcccctaaaatgcataaccatagtctcatccccgtcaattgcagctatatggctgtttggaattatttctcttataactagtcccaccttctcttaattttttaatcgacttggttgagaaggaccaactttacaatatgagcttcatattctcctttatctttcaaactttattgctcttgctacttaaattacagttaacctatggatatctacttttgcaaagaactaaaaccttgcttcatcacagaaccaaataaacagattgtatttctctgttctctttctcttcctgcttctgtaaaaggtatgataccttttgttccacattcttttctttttcttttgagtatgctagttgcagtgctttcaggttttcttattctttttcttttttagcctttcttttagaaaccatctcaataatgcataatttacagtttacatttttgggtttttgaaagtggagtaagaacttagattgtttggcaagtgtcttataaagaattcttaatttaatatttcccgtaagtcatagttatctccaattgtaatatctagtccaaaagcagatttttttttttttttttgagacagagtctcactgtgtcacccaggttggagtgcaatggagcaatctcggctcactgcagccttcgcctcccagattctcctgcctcagcctcccaagtagctgggattacaggtgcctgccaccgtgcctggctaatttctgtattttttgcagagatagggttttaccatgttggccaggctggtctcgaactcctgacctcatgtaatccactcaacttggcctccgaaaatgctgggattacaggcgtgagccatggcgcctgtccaaaagcagtttgttttaaagcagaaaaagcaaaactgtgtttattgtctttccaaagcattcaacttagtcttcagagaaacagttctctttttgaatcatttaatctacttagtcatttcatctaatgtacagtttaacaaaattacaaaattgcaacaagtgtggctggcacaatcaggtttggtgacaaacacaactaactcttggtaagcacccctccctgttggagtgaacataagtgcctgggcacactagagaactgtggtgggcattagctatactgtaggcttcacaggagtggagaacactgttaatatggagagctggaaattggttaagtaaactttggtattctagtaaacttgcccaagaagtttaattcttatatatacctagtttttccagaaaagttacattaaggtattaatttaaccacagcaggtaaaagttttttgtttttttttttttttcaagacagctctgttgccctggctggagtgcaatggtgctatctcggctcactgcaatttccgcctcctgagttcaagtgattctcttgcctcagcctccagagtagctgggattataggtgcacatcaccatgctggctcatttttgtaattttttcttttttaaatgagagtctcgctctgttgcccaggctggagtgcaggggcgcgatcttggctcactgcaacctctgcctcttgggttcaagcagttctcctgcctcaccctcccaaggagctgggattacaggcgcatgccaccacgcctggctactttttgtatttttagtagagacagggtttcgccatgttggccagactggtcttgaactcttgacctcaggcgatctgcccgcctcagccttccagagtgctgggattacaggggtgagccacagcgcctggcctcaacatttttaagtgttaatttaatactatcttttctctatcagcatattgtatttgtttgcttatattatatgagcattttccaacatttgctttattaccctctctgtaatatataatcccatattcagatttcaccatttgttcccaaaatgtcctttatagcataatcaacatattttaaatatcatttgtatagaaagctatatattgaaggataccgacagcagtgaaattgagcctggcatgatggctcaagcctgtaatcccagcactttgggaggccgaggcaggcggatcacttgaagtcaggggttcgagaccagcctggccaaaatggtgaaacaccatctctactaaaaatacaaaaattagccgagcatggtggcatgcgcctgtaatcccagctactcaggaggctgaggcatgagaactgcttgaacctgggacgtggattttgcagtgagctgagatggtgccactgcactccagcctgggcgacagagcaagactcagtctcaaaaaaaaaaaaaaggaaagaaaaattaattgaagctgttgcaccacagggtgaatggagcaacatactggtgaaagtaaggtgaatgccaactgttgtttttgtaatcatacctaataaagtttttatcagtgtgttagatggccttcaaaatatggcagagaaatccataaccaggcaaaataattttgggtctcatttcttcttataagttattacttgcctataacaaactaatctaaaatatgcctttctgctctaaaagctaaagcttaagagtcccttggcagatgggacttttaaattattcctgtagaaaattggtagtatataagtgttttaatttattatgtgttttaatttattcctgtagaaaattattcctgtagaaaatcggtagtatataagtgttacagctcttagaatttgtctagcaggctctccggtttttgccagaatgcccaccaccccccgaaaaaagaaagttggtagattggtagtatacaggatatatcagtatcctttgggtgtttaggtataaggagatctgcttagaaattataactggagagctgagtacagtggctcatgcctgtaatcccaacactttgggaggctatggtgggaggattgcttgaagctaggaatttgagacctgggcaacatagtgatacctatttctggaaaaaaaaaaaaaaaaaaaaaagagagacattaaaaaaaaatgagacaaagaagatagaacaaaaggctagataatttggaagaaaagcatgaaagtaatgtcataaagaattcaaagaggacaaagtttcaaatagagggggaaatgctgtaggggtattgaggaagatggggactagaaagcatccttttagatttggcaagcaggcaagcgttcattggtgaccttgtggagaatagttggaatgaagtaagtctctgatcatcctgagtcagggtcaagtttatcttgtcattattcgggtatgaggctagtttttctctttggtatcttgtggctcccatggccggaagttggtgctttcttcagtgctagttacctctaggaagaggaagcgggcggctgttcctggacttctctgaatacctttttctagttttaaagttttgaaccacaagaatgtattacttattcagcaaataaaacatttccaagtgaaatacagaaattggccttttttctatgatatagtgctgtgattatcattattgttcaagtgctattattattttgttgacatatctgcccccgcctttagattgcaggctcctggagagctgtctcctgcagtgccccagtgtctagtatgagggggtggcatctaatgggttatacagttgttaaggagcataagatgtccctacgtaaaatgctagtgtagcatacaatgaggtttgatgtcagaatggcatcagttctgctttttgttcctcttgtgaggagcctgttcaaatgccctactgtctcttgtccctatgctgggggcacatggtagcagtagtaaccatcgccttagtgcccttagtgaggtttgataaacctgcctgctgcctacagttccaaatttgaccaggattatatgacatcatttagaagaacccttaggagggaactctgaaagcaatgtgtctgtctaagcactgctgttgctggcagaggtatctagaggttacttagggatgagcacgattgttttctccagctctaaaagaaattaaggactctcagttttttttttttttttttttgggactctgtctcaaaagagtttaggtctgtgaatggtcttgctctgtcacctaggctggagtacagaggtgcaaacatggcccattgcagcctcaactttccgcgctcaagtgattctcccacctcagcctcctgagtagctgggagtccaggcctgtgccaccatacctggtcagttttcttgtagagacaaggtctcactgtgttgccaaggcttgtctcaaactcctggattcaagcaaacctgctacctcagcctcccgcagtgctgggattacaggtgtgagccaccatgtctggctcaaatgttcttttgtctttttctttgccagttttacttctttccacatgtcaaatatatatttttaaagatattagtaaaaaataaagagagtttaattgctacagtgtctaaactaggttttttaatggattgaaggctatcagaaggacgttttgaataaacttattttgtttggagtttaattttttaacaaaaacccaagttggaatttaaggtaaatgaaaacttttttgcattggagtgaaatataaggaaataataaattcattaattttattaagtgatcattaacttcttaaaaatagagctgatacctatgagctatacttagtattagatgatttagatagcactgctttctcttcagtagaaaataatcagaaaaatagtttatcatttaagttttgtcaatttttttccctaggaagataagaaaaatacagtagaagtaagattgacaaaaaaccgtacagggctgtttttagctttctagtcttttggttttttttggtgggggggagttattttttatttttagttttatagaaattagaatattcttcctggccttgttttgagaggttttaatttaaataaaatttaatttgagagtttttgaagtgaaatgttacgatctcccaattcaacattataattttactgcaggataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtat

SEQ ID NO: 76 - DNA, 86880 bp, Homo sapiens
tctcccaattcaacattataattttactgcaggataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaggatgctgtgtcccctcattccctgacgtttcttgattgtctgccgcgtggtggactctgctgtgtttcctgctgtgacttctgctttaaggatgtccctgccccaccccccagtttcaagagtggatctgatcagtgtgtggtgggagacagaaaattgggagctggtttgcggagcatccagctgctgctttccctgtaccactggaattctttcccttatctgtcactcccagtaagtagggcatgtcattgttggctttctttaaaaatatttattcttccttcagagtcggagctctgaatttcttttttctttttttcttttaagacagagtcttggtttgtcactcaggctggagtgcagtggcgtgatctcaactcaccacaacctccgcctcccgggttcaaacaattcttctgcctcagcctcccgagtagctgagattacaggcgtacaccactacacccagctgatttttctatttttagtagagatgaggtttcaccatgttggccaggctaggctcgaactcctggcctcaagtaatccacctgccttggcctcccaaagtgctgggattacaggtgcgagccaccgcacccggcctaaatttcttttatctcaatttttgtcttctcttctacagagaagatgaggaaagaagtcaaggaagaaaaaggaaaggaaaactccaggtttcaggtgcaggacagtaggaccttgcattcactcatctgcccagtcagttgctgtgcgccagtggtgtggctggggtgggtggacacacagaggggacacgaggatcagcaggcaagatgtacaaagttggagacgatgcacgctacatgttagaattctagaaagatgcagctgggggttaaacaggagactttatgtgggaagtggattttgaactgggccttgaagtgattgacagtgctggggcgtggggtgggtacttcgggaatacagagcacacacactgctccaaggagcttgggtctggaggacagagggaggccaagtgagttctcacccaagagctagtttcatttaaaaatcaggggaagacagaagcaatgtgtgcgcatgcctgtgtgtactctagtctgcaaaataggttatattattttagaggaaagggactatccaattacttgggaccaccagcaacagaagccccccttcccaaacccagtggtttaaacaataaggaaatacactaccttgcaaaacaagaagtctagtggtaagaaatcccaggcttgctaatttagtgacaacgatggcatcacgaccagatccttcctcctcattcttttccctctacctgctggttccccgaccttaatattgctgccacagtcccaggcatcagaaatggaaaagacagcaccctttttggggggatactgcttttttctttgttttttgttgtttttttgagacggagtctcactctgttgcccaggctggggtgcagtggtgtgatctcggctcactgcaagctccacctcccagcccaaagactgggctgaaaggcactgggttgctcatgaggattcagcccctagggttgaggatcttccaggctttggggaagcatatggccatcaatgtcgaataaaactgggcttctggaagagtggcttgtagacactggggacgtctggcactgggactgagcacttaccctgtacaagaagtgaggaacagcttgtgacaggctggggcttgagccatgctcccagacctgcatgggaactcttattcttgctcatgaaatgtatccctgaagccaagcttctgctaccaaaatagcacgatttgacagcagtgctttcagccttacagcagatactgcctacgacctctccctcaacagaacctgcagtaggggaagctttgcaggggggaacgttgcacatctcgcacacccttgcgcgtgggatccacagcgctcccacacccgtgcgcgtgggatccggagctccccgcacacccgtgcgcgtgggatccacagctctccccacacccgggcgtgtgggatccacagcgctcctcacacccgtgcgtgtgggatctggagctccccgcgcacctgtgcgtgtgggatcgagttctcactgcgtgtgtctttctttgaaccctaaaagtttcatctggactgctgggtatagaaattcctgctccaaggttaggggactgcataccttctctgtcctgtgtaactaggtacttcataacactaagtcatgtgagatgggaacattaagaaaatgaactcctgctagtatttaaacgtgtgaccatgaggcatgcctgaaactgagaacatggacatcagcaacatactgtgcatgaacggcagctgtttgagtgccagatgcctcattccttgttcaaccacacttctcagttttcttcatatgaagaaacttacgtccaaaacatgctatttcccatgtgcctaacagtacacctttaaaaaatatcatgacttgtgaaaccaacttgattgttctagtctacaccaaaaataattaggccgctttgacgtgtgaggcaggcagagctgttgccagttggctggctgtaatgcaatgactgtcgtatggtagtataccatggttctcagaagtttagatgtgccaggctggagtgcagtggcacgatcttggctcactgcagcctctgccctctgggttcaagtgattgtcctgcctcagcctcccgagtagctgggattacaggtgtgtgccactacgcccatctaatttttgtatttttagtagaaacagggttttgccatgttgcccaggctggtcttgaactcctgacctcaggtgatccacccacctcggcctcccaaagtgctgggattacaggcgtgagcaaccacgctggccatgattcatcttttctaaggtcatcttaaagacacagacttgattctgaactactcaagcatggtatattttaatctttatgctttgtgggaaggttttttctatataaatccattttcttggctgggcatggtggctcacacctgtaatcccagcaccttaggaggctggggcaggaggattgcctgaagctaagaattaaagaccagcctggacaacatggtgggactctgtctccacaaaaaaaaaaaaaaaaaaattaagcaaattagccaagcatggtggtgcacacctgtagtcccagctacgatacatacatgattcattgatcatgttgtctgtatccttaagttgtcccatcttcagggccatgtgatgcggagtttccagaaagcaacatgggagtcagcatgttcattcactccttcaagtcaataagtgaggctgcatttgtaagaagtccaggaggagacagggcagctttgggacctagggctgtggcaaccctgacgttaccatcctgggcttgctttcttccaggtgtgtatgtagctccacagatgctacagccacgtagtcatggcagtcaagaataacagctaccgtgtacagagtgctcaccctgcgccaaggggcttccacatttaattctcctagcagcccaacaagtgttgatgctgttaccattatcctcattttgcagatgaggaagcaagcttggagagaagttcagtagcttgccaaaggtcacatggctcaggaccaagtgcagaaccaggacagcaagcctctgtcctggcggttctcacccagtctggacccaaaggcaggaaagtgttaagaaacacttgctggcaatgactcaagcaggtggtggctgcagagagagagagctctgtggctctgagtggctatgtgtgggaacacccagaccttcctgttcaaatgcacaaaagcacattttcgctcctctctggtttttcaaatccctgatgctgatcaggaaaaaatgactctacagtttaaggactaaggactagctagctattggaacatcaaagtcacagttatgctcattgaaatagaatcttacagctaaaagaggtctcaccggtgtaattttttaatttttatttatttattttttgagacaaagtctcatgctcggtcacccaggctgaagtgcagtggtacgatcttggcttactgcaacctccgcctcccaggctcaagcgattctcccacctcagcctcccaaggagctggaactacaggcacgcgccactacgcttggctaatttttgtgtttttttgtagagacggggttttgccatgttgtccaggctgatcttgaattcctaggctcaagtaatccacctgccttggcctcccaaagtgctggggttacaggcatgagccactgagactgaccaacaggtgtaatttactcctttcattttatagacaagaaaaccaaatttcagattgatttacttaaatattgccagctattgacaatagactagaaatactcagatctctgaactagtgtgataatctttatattactgtgatgcctctatttttctataaactggattttcaaccagcttttgtgcagcatagctttctgaggaaggatttgtccctgtggtttgaatggacggaagctggaaggaaaaccccgtcacttactatgcaaaagtccagctggtctctgtgacagctggaggacacaggaactctgccagatctatctcagccacctcactttatgaaggatgcttgacctgtggttcagtcattttctaggacaaaaggctgttaacaagatgtacaagagctcttgctttcaacgtttgtggagctctcagaagcgctgacttacagcagaccagcgtgaggcttaacttaggaatgaaccctaccttttaaaacacagtttactattgataccctttttttttttttttttttttttttttttttttttttgagacagagtcttgctctgtcgcccaggctggagtgcagtagtgcaatctcggctcactgcaacctccgcctctcgagttcaagtgatcctcctgcctcagcctcatgagtagctgggactacaggcacatgccaccacactgagctaattttcgtatttttagtagagacagggtttcgccatattgcccaggctggtctcgaactcctgacctcaggggatccacccgccttggcctcccaaagtgctgggattacagacataagccactaagcccagccactactgatagacttttgaggaggtgagaagcccaaataaggaggctttggatgaaagtgggctgcccgggagaggatagcatgagtgtgcctgtttgtgtcttctgttttgtgttccatacctctggaattttcattcagtaggtctgggaatttgtatttttaaccagttccttgcatgtttgtttgtttgtttttgagacagggtcttgctctgttgcccctgctggagtgcagtggcacaatcacagatcacctcagcctccacctcctgagctgaagcgatcctcctgcctcagcccccggaatagctgggaccacaggcatgtgccaccaccacgccaggctcaagttcctggcatgtttctgaagcactctagtgttggagaacactgaactctatgatctggggttgggcctagcctaattttcctttaagtcatggatgctcttacccagcatttatccagcacacagactgtttaatgtcacagccacagcgccacctagtgtatgtgtgacttccaaacggcgtattttcttagaaacattagtctgtgaacatttcaaaactcaacgggtggtatttcttttctgccatggactctccaagtgtatgccaagccctatgggggcaagggattaagggcagttttctctgatctagtttggtgaattatattcacagtaactctggggagtcttgggttaactgtgggggaggggcaataatttgacaaggtttgggaatccttaaactatagagttttctctaagagtacacagttaattgcaaatagattgaattatttgacataagaactttagacattacttccaggccacatagttttagcaagtaagtgactttaaaatgaatccatcttttctcagcaaaattaccggttttgctttaactgcatatgaggggttattttaggtggttagaacatagtggaaaatgaggccaggcgcggtggctcacacctataatcccagcactttgggaggccgagccaggtggatcacttgaggttaggagttcgagaccagcctggccaacatggcaaaaccccatctctactaaaaatacaaaaattagctggatgtggtggtacgcgcttgtagttccagctactggggaagctgaagcaggataatcgcttgcagtgagctgagatcacgccactgcactccagcctgggtgacagagtgaggctctgtctcaaaaaaaaaaaaaaaaacctagtggaaaagagtttcaaagcgttttgcgtgtcactcagacatggctgtgggtggcattttagttcttatcgtaacctgtgatcacagtgttggcctcatgggaattggatgagcataatcatatcactagaagttcttggaaaataagtatcattaactgtgggagagcagtgatattttcacactctaaaaagtatacatatcctgttgcttagtaatgccgagatcagcatctgttttgttattgtagcttgaaatatcatgaaaatgtaattggagatgaaggtgctgatggcatttagcaattacttagaggttagattagtgacatggtaatgataattagattatatgcctttgaacaatttctattcagagacttttgatatatgatattatgaataagataatgttagaaattccaaattttagaacattaatccatctcaatattaatttaaaaataaatacacatacatacatacatacttctttggtcagccagaatttttttttattagccttttcctcacataaccagccagtgttaaaatagatttgatgtcatgaaggttgcagcttttaggcagtataattttttttcctggcatgcataattctgtattatgtacatggtttcattcatccttttatccagatgtctgaattgatgtaacccagctggattttattggagtttagacctagaagggtagaagacaaatctaccttatcaagggtataacatgcctaacctattagtctttctattcaagtaacctgacttaatatcattaaatgctgggttgctgttgctccaggaatacaggattgtggcagtttggtggggcagggaggggaggttggagtaccagcagagggtttcatagagggaacaccccatgtaacaatagagaaagaagactgagttgctggaggggcttagcagaaaatctatgggaactcttccacagctggtatggacttcacgcaccaaagcacattgagattagctgtggtttcttagggattttcactacaatcaattacttgaatacttctagagcatttagtatcccagacacccctgtttcatgattttcattttaaaatgagtcaggcagtgattacctatgttcttaaaaatccatcctggataaaaagaactacagaaacaaaagaacaaagtccaaagctacaggcgctgtgaagagcagaatgaacagtgggtgtgtgcttggctcgaggaaccatggctgacagccaccagacctgggttctggtcctagcttttctgttaaaactccctgtgtcgctttggcaaggtcatttgacctctgtttgattgggaacctctgttttctccacattgaccttgacatttgtgacactgtgatgaaattcacagtgaaatgtaaatttcaaagaagagttcatcagatcttatttgttacctcatccctgtgaacacagcttctagattcttagtatcaggtcatgaacctataaaattatctttcagaatgtcttcaacatcaatatttttaataatccattctgaggattgcccagcatttaagagaaaaaagccttaggctgaaactggcctgtgatgaaggcagggacatctactttgattctggtaactggattaagattttcacacatgaagactttacttgggcaaattttgttttacttatgttatttataaatgcaccaaaactgtgactgaatgaaaattttccaccgcaggagtttcctctgcccttctcaacctaacagggccgcaccaagttaacagaaattatcactggcttagaaaaggttgtggttttcagtgtacattaggagggttactgtcctgtaacccagtttattattttaatattcttgaaagaactgaagtaatgaagggagaggctatattttctttagaagatttttccatgttatttgaaaggttttattcacacatatttttcttagcagaaaaacaattaaattgaaaaaattttaaaagtacttttaaaacgtacttttaaatgtacttttaaaatgtacttttaaatgtacttttaaaatgtacaaaaatattttaaaatgtacattttaaagtacattttaaaattttttcaattaccctttaataaagctggaggaaaataaataatataaaattatacattttgtagatgtgaaatatgtcataaaaatcaaagtttataaaaaatgtttaccaaaatatataaccaggctgggcacggtggctcatgcctgtaatctgagcaatttgggaggctggggcgggtagatcaattgaggtcagaagttcgagactagcctggccaacatggtgaaacctcatctccactaaaaatacaaaaagtaagccaggcatggtggtgcttccctgtattcccagctacgtaggagcctgaggcaaaagaatcgcttaaacctgggaggcggaggttgcagtgagccgagatcacactgttgtactccagcctgggtgacagagtgatactctgtctcaaaacaaaacaaatatataacctgtataaggctaatttaaaatagttttaatagttttgataggaatgcatttccagtttgcttattaaaatttattatggtgtgagttttaaaattgtatatacaatggataaactgattttaaatatatattttttatttcaatagcttttggagtataagtggtttttggtttcatgaatgaattgtatagtggtgaagtctggaaatgctagtgcactcatcaccccaggaatataaattgtacccaaggataaaatgatttgataggctcaatcatgatcgatttgaataagctgatacttgaaaatatttccttattcctgacgtttgataacttcaagtccctgagacccagaacaaaggccttcttgtcgtgaaaaggcagctacatctagtggttggtggcattttcattggaaaatttggtttatgaaaaaaatccttcatagctgtctttgctgacattctgtggttgtacagagcattataactaatgtggtgtgtatgtgtaacttaactgaggtataacttttacaccataaaattcacccattttacctgtacaactcaatgatttttaacaaatttaccaagttgtataatcatcaccacaatacagatttagaacatttccatcaccccagtaagattgttcactcccatttatagttaaccaatactttggttttatttattattattattattgtttttcttttaaagactaggtctcactctgtcgcccaggctggagtgcagtggtgcaatcatagctcattgcagtctcagactcctgggctcaagtgatcctcccacctcagcctcccgagtagctgggactacaggtgtccattgccatacctggctaatttttaaatttttaaatgaaaataatgcccaggctattctcgaactcatggcttcaaacagtcctcccacctcggcctcccaaagtgctaagattacaggtgtgagccgccgcgtccagcccctggccagtatgttgactgtagcctgtgaaagacccttagttagaggacccggttaagccagggccggattcctgatttacagaaactgtgagataataaatgctgtgttaagcctctaagtttggggattgttatgcagcaatatggaactaatacgtctactctccaagctaatctagcaatgtatgcaactgaatatccaatctgccaaccacagagaccagtactgtgtcccttcactggcactatcctcggaggagaagaaccagccactaggtggcaagtcagtgacagggaccctcttccaccttggaagggacagagacagaatgtttgatcctctggcatgggatacctcataacatcacatcaggcctgggaaccacgttacagcaagggaggtgggagagtggcccaggaacacaggatcccgtagtgaagccacagaacagtggacctgatagaggcatggctgaagtgcccactccagggcaggactttcagggcataaggtgccatcctccaggacacaggctgcactttaaagacctttacacagtgctcagtgggaagaatgcatgggcctggggaccagaggccctgcctgtctcatccccagggaccagttgggaaaggaatcggcatttcccattctctgtaagtttgggttctgcaggtctaaagggcctggtcccaggaagacacttctgccaggggaggtgccaccagggcactcaatctccttgtgccaagggaccttgcagcaggaagaggagtcaccctcctggtggcactgactggccaccattaccaggaggaggaaaggcttctgctccagactggaagtatatgtttggcacccaggcgatccatgtgggcacctcaagtgcagcaatcccagctgagaacagcagatgtgctggctgagggatggatgaatggggaacagatgtagaggaaagagacgatgagtgtggactgcagcctgaggccagctgtggtgggaagggctgtggtttgttctattaaccttcctcttctaaattctcccataggctaggtatggtggtatacacctgtagtcccagctacttgggaggctgaggcaggaggatcccttgaggccaggagttggaggttgcagtgagctatgatggcaccactgcattccagcctgggtgacagagtgggatcctgtctctaaaaaaagaaaaagaaaaagaaatccccaggaggaggcgcccccacactccccagaacctccaaggagctgctctcttaatgtatgtgagcagctggcgggcaggggtggttgtggggaagactgggacaacccccgctcctctgcatacaggatcttgcccttagctgctgggagtgctgtcagcccacagccttcaattcagtccctttgggtgctgcctcacctgatgctcaagggtctgtatccagcaatggacccaggtggccccaccagaccacacctagggtcggtctagctcctgagctccctgtggggtcagatgaggtggtcatttggccagcacaggagctgtttctcccttcacccactcgtggactcttgccctcccaagagcatccctatgaaaccttgtgtgcatgccaagtccatctcagagcccgctctctggcagcaactttatgccgatcagtgacaa

SEQ ID NO: 77 - DNA, 164354 bp, Homo sapiens
tccttcagaatttaatcaaagaagaaacacgtttcttcccattacaaaaccatactcgagttcaaaatggggtactctgagtgttttaaatagatttttttttttttttttgagaccgagtcttgctctgtcacccaggccggagtgcagtggtacaatctcagcccactgcaacctctacttcctgggttcaagagattctcctgtctcagtctcctgagtagctgggattacaggcatacaccactatgccccactaatttttgtatttttagtagagaggggatttcatcatgttggccaggcttgtcacaaacttctgaccacaagcgatctgcctgcctcggcctcccaaagtgctgggattacaggcatgagccaccacgcctggccatttttagtagaattttatcccagaagctctgtgatcctgtccattgtaaccctgtttttaagttttcagggtccctttcttttctccatttaatttcttcttctcctcctcctttttcttcttttttcccccccacccccagagtcttgctctgttgcccaggctgccattcagtggcatgatcatggctcactgtagcctcaacctcccaggctcaagagatcctcccacttcagcctcccgagaagctgggactacaggtgcaagccgccatgcccggctaattttttattttttgttgagatagggttttgccaggttacccaggctggtctcaaacttctgggctcaagcaaactgtctgccttggccttccaaggtgccggaattacagctgtgagccaccacacccagcccatttaatttatttgttcagcaaacactttgttgagaattgattcttgtctagcaccatgaccttttcttttcccactgttttctttctgtttagctcaattatcaactaccaaggcagcagaatcataaaattcaagagctccctcaactgcacaaaagtccactcttttcaactgtaagacattcttccctctgcagttttttgtaatatgaagaattttaattagcaaaaagttttataagacgttatcaaataacaaatacttaatttcttttctttttttttttttgagacggagtcttgccaccatacctggcctatttacaggcatcctgtttaagagatgtttcaggccgggcgcggcggctcacacctgtaatcccagcactttgggaggccgaggcgggcggatcacaaggtcaggagatcaagaccatcctggctaacgcggtgaaaccccgtctctaataaaaatacaaaaaattagccaggcgtggttgcaggcgcctgtagtctcagctactctggaggctgaggcaggagaatggcgtgaacccaggaggtggagcttgcagtgagccgagattgcaccactgcactccagcctgggggacagaacacaagactccgtctcaaaaataaaaaatagaagagagacgtttcaggccaggtgaggtggctcatgcctacaatccctgcctttgggaggctaaggcaggaggatcacttgagcccaggattttgagaccagcctgcgcaacatggcaaaaccctgtctcttcaaaaaaatacaaaaattagccaggcatgagtgcatgcctatggtcccagctacttgggaggctgaggtaggaggatcacttgagcccagggggttgaggttgcagtgagccaagattgcctcatttcgctcaagcctgggtgcagagggagactctatctccaaaaaaaaaaaaaaaaaaaacacgtttcagatgtttataattcaggttatcgtattcagcttagagggagaaggcttaatgttagttgggtactaagtgcagacagaggaagtgtcatttccgttgtcctcccaacagagcagatccgtgtccctctaaataaaatggttgagagagaagagtcttgagttttgctgcaacaaaaaactagggaaaaaaaaacaaattcaatttgaggctctaagcaaggagcagcaaaatgttgaaaaggtaattaacatctgtattccaaagagcagcagagagcaggttagaacagatggtttcagaagtcataaaaataacctaggacagtctgtaggtggaagaaagagcttactccacgtgagtgacaaggtactgtagtaaatagttctttagcgttttctgttgtcttaacacttgctttaactgggtagtttgggcattaataaggagatggctcgcgtattgttattgtgatgaataacttcttcgaaaaaaagtacttgtaaatgtaatgagtggtgtatccttgcctatctgttcacagcatctggaagtaaatctaatcccggtcagaaactatcaataaaacagtggcagttagctgccaacaagccatagagtcaaaatctagccctacgtgaagtgctgcagagtgaaaaatctcacacacgaaaaaagtggtgcttggtaaaagttaagagaacaaaatatagcaggaaaagacccatgagttaaagccatagttatagaaaatctagtagaagcacttgctttccaaaggctgaactccagacagcaaataattcactgattttggaaactttccaaataacaaaatgttctgtttcagaagtgtcttgagcttttaggagatcagaatagagaaagggtacagtgcccattcaggtctcgctttgtgtttatgctgaataaaagttctccacgggagaatactgagtctccaataagataggatgacattaagagaaaacaatttttttatttttattttttgagatggagtctcgtgcttttgcccaggctggagtgcaatggcatgatctcggctcactgcaagctccacctcctgggttcaagcaattctcctgcttcagcctccagagtagctgggactacagaggcccaccaccacacgcagctaattttttgtatttttagtagagacagggtttcaccatgttggccaggctggtctcgaactcctaacctcagttgatcctcctgcctctaattttttgtatgtttagtagagacagggtttcaccatgttggtcaggttggtctcgaactcctgacctcaagtgatccatccgccttgacctcccaaagtgctgggattacaggcgtgagccatcgtgccgggccaagaaaacaatctttattcccatttaagagagctatctaagtgtgtttaatccttatttcaagttaagtgcttagacttggttgtttttctatacaagcaattatcttaccctaaatgctttcctttaccgtgtgtgtatgtgtatttttagagacaaggtctcactctggcacccaggctatagtgcagtggcacaatcacagctcactgcagcctcgacctcctggactcaagcaatcctctcacctcagcctcctgagtagcagagagtacagatgtgtgccaccaagcccagctaatttttaattttcttttgtagagccagggtcttgctatgtcacccaaggtggccttggacttctgagctcaagcttccacctgcctcgggctcccaaagtgctgggattacaggtgtgagccaccatgcctggtccatattctttatttacaatgagatttataaaacagttagtaataagacatggattgaagaatttgaaaacctaggagacatttatcaagaaaattccccaggattacagtaactaaagtgcagttaaggcgagacagttctcaagttgtttatcaccacctactaggatccaatcccttttttttaaacttgccaaaccatttgacaatgtacagatgctattttatttataaatttggttattctacaggttgttaaatttgatttgcaatataatcatagtagcaaaaagtcatactagttttgtatttgatagaaaaatattttaatagtaattataacagcaaattatagtgctttaccaataatactgaagacttctgtaaattttggaaatctgaaactgatcatgttgaaaaattaatgcaattcaggaaagacttaaaaacccaatacagtgttaattgatcctgacaatgatttatttttgcagtttgcacagagcccttaaaaggagatatttcttgaaggatgaatagggatttggcaactgaaagcaagatagcaggatgctctagcagagggtacggcgcaggcagaggcacggccatcaggagaggccctggcctttgggagaggggctccagtgaccagggcatgcattgtctctatctctgggggtgctggctcatgcaggcttcactgagtcctatgagaaatggaagaatggtattctattatgaaagaagggctgggtgtggtggctcacgcctgtaatcagcactttgagagactgaggaggcgaatcatttgaggacaggagttcgagaccagcctggccaacatggtgaaaccccatctttactaaaaatacaacaattagccgggcgtggtggcacgtgactgtaatcccagctactcgagaggctgagaaaggagaatcactcgaacccaggaggcagaggttgcattaagccgagatcacaccactgggcaacaaagcgagactccatcagaaaaaaaagaaagaaagaaagaaaaagaaatgtaataataatgatatatcctagaaggaaaacaaaaaacaaaaaagctccatgtgctcattaacttctgtctgcctctgtagatcctcttgcccgtgttcaccctgctctgtgccctgggagggctcccttgtctttcagtttcctgttgggctgaaccaatgggagtgctgccaggggatcagtggtaggagtggctagggaccggctgcatgggttccctgtggcctctaccaaatgccacagtccccttcagaaagccctctccaggcaaacccccatctggtacccaataactattcatttcccctgtctttataggcctaggaataacagctccctgtggtttactgtacaaccagacttgtgcacaaccagagtatacaatgccaggtagtgtgtactctgctaggtcttatggatttccttaaaatttgtactcaacattgtaaataatccctttattatattattcttttattactttttttttttttttgagacagggtctctgttacctaggctggagtgcaatggtgccatcatatcactgcagcctcaaacccctgggctcaagtgatcctcctagcctcctgagtagctgggactagaagcgtgcaccactatgcttggctaacttaaaaaaataattttgccgggcgcggtggctcatgcctgtaatcctagcactttgagaggccgaggtgggtggatcatgaggtcaggagttcaagaccagcctggccaacacggtgaaaccctgtctctactaaaaatacaaaaattagccaggtgtggtggcaggcgcctgtaatcccagctactcaggggattggggcaggagaatcgcttgaacccaggagacggagtttgcagtgagccaagatcacgccattgcactccagcttggatgacagagcaagactcagtctaaaaaaaaaaaaaaaaaattgggggccaggcgcagtggctcatgcctgtaatcccagcactttgggaggccaagacgggcagatcacctgaagtcaggagattgagactagcttggccaacacggtgaaaccctgtctctactaaaaatacaaaaaaatttagccaggcttggtggcgggcacctgtagtcccagctactcgggaggctgacgcaggagaatggtgtgaactggggaggcagagcttgtagtgagccgagatcacgccactgcactccagcctgggcaacagagcgagactccgtctcaaaaaaaaaaagatattcaaatattcaaatcacaatagaaagtcttgcttttgtgctaaggatattggcaatgcagttcaaggttgaaaagaacattattggttcaatccaaatgggcagattaaaaaaaataataaaagaaataaagaatattattggaaggaatatggatggtattcctttaagagattcagaacattacatagaagtttcatgtatgcttccttgtactgataattcagaatcctaggaacagaggacttgtaaggaaaacatagaaaatgcacttcatcactggtggggcacggtggcgctcacgtctgtaatcccagcactttgggaggctaaggcaggtggatcacttgaggtcaggagttcgagaccagcctggccaacatggtaaaacctcatctctactaaaatataaaaattagctgggcatggtggtgggtgtccataatcccagctactcaggaggctgaggcaggagaatcacttgaacctgggaggcggagttagccgggatcgtatcactgcactccagcctaggcgacagagcaagactccatctcaaaaaaaaaaaaaaaaaaagatctgctttggtgtctgccacaggcagacgccgtgatttgcttactcagcacccattactactttttcttccttgctaacacaactgaaatttgttggtacaccaatatttcagccctaggctatagaccatcctatacctagtctaatcattacaaatcaatgttttctactactgtaatctccctaaagctagggatggccatatgcccatatttagccaatgacacctaaatgaaagtctacaggtgtggtttagagcgaggtctctcagccttggcaccattgacattttggggcagataattctctgttgtgaggggtttttctggggattgttgaatgtttatatcatccctggaccctacccactagatgacaatagcacccccttagttatgacaaccacaaatgtctccaaacattgtaaaacgttgcctggaaagtaaaattgtccccagttgagaactactgttttagaggaaagatcttgtcttgctgattaaagggaactaatgtacctggtacctccttctctccccttcttcctgccttgaacaggatgtgaggattgcagctgcaataaccattctgcaactgtaaggaaacagtcaaaagattctccttgaaaccgttgctacttagcagcgatcacctagcctttgatgtcttattatgtgaggggggaaatgctctttatagttaatgtcactatagcaaaactttctgaactttgaaccaaatacatcctgtattagtttgtgttgctgtaacagaataccagagactgggtgatttataaagaaaagaggcttatttagctcatggtcctacaggctgagaagttcaagggcatggccgtggcttcagacaagggcttttgggctgcatcataacatggtggaaggtcaaagaggaacagacacgtgcaacgggctgaacacaaagggcgcctgtactttataacaacatgccatcgtgggaacaaacccatttctgcgagaactgatcaagtttcatgagagtgagaactcactaccgtgagaacagcaccaagccactcgcaaaaacagatcccccatgaaccaaatgcctcccattaggttccaccccttaaaggttccacctcccaatgttgttacattagcaattaagcttttgtttttgttttttcagacaaggtctcactatgttgtccaggctggactcaaactcctgggctcaagcaatcctcctacctcagcatccttaggagctggggctacggcagttaaattttaacatgagtttctgtggggacaaatcatatccaaaccatagcacattgtgctcaagatattggctatgcagttcatggcttaaaaaacattatgggaaggagtagagacagtgcatataataaagtatgtatagtgaagcagtacaattgtatttctatttaaattgaaattaaaacatttataatgggccaggcacggtggctcatgcctgtaatcccagcatttgggaggctgagttgggcagatcgcctgagctcaggagttcaagaccaccctgggcaacatggtgaaaccctgtctctactaaaatacaaaaaaattagccaggcgtggtggtatgcacctgtagtcccagctactcaggaagctgaggcatgagaatagcttgtgcccgggaggcagaggttgcagtgagcagagatcccatcactgcactctagcttgggctacagagtgagactccatctcgaaaaaaaaaaaaatgacttagaaaaatatttaatacttgaaaataaatctgatgaaagatgtacaaaatgtgtacattgaaaacagcaaggctgggcatggtggctcacgctgtggatcacctgaggtcaggagtacaagacaagcctggccaacatggtgaaaccccgtctctactgaaaatacaaaattagccgggtgtggtggcacatgcctgtaatcccagctacttgggaggctgagccatgagaatcgcttgaacctgggaggcagagattgcagtgagctgagatggcgccattgtactccagcctggggaacaagagcgaaactccatctcaaaaaaagaaaaaaaagaaaacagcaaatcattgctgagagagaagacccccataaatggggagataaatcatgagttccatagtgttgagatgttcactctcctcaaattgatctatagatgtaatgcaatcccaataaaaatctcagtagtctttatttttagaaattggcaggctgattctgaaattttatagaaatgcaaaggagctagaataatcagaatatgttttaaacaataatttggaaaacttatgctacctcatttcaaatctactgttaggcaatcaaggcaatgtggcatcgatgtgaagatagacatataaattaatagaacataatagagtccagatacatacatacatacatatacacaaacacacacacacacacacatacacacatatatatggttaattgattttgataaatataccaagctaattcaatgtatccggttggtctaaaggtaattctggtttttgtgattacttaaaagtaatgaaaagtaatggcaaaatccgcaattacctttgcaccaacctaataaattgatagtcttttcagcaagtggtgctggaacaactggatatccctatggaaaataaaaaataccattgaacttctagtctcctttcgcatgtaaggagattaaaagtgaccactccatcttaagtaaaaagctgaccaagtggaaaaatcaacaattcttagattcgtaagagaggtcacagggcaaacaggtgaccctgtttggagagacagatggacacagagaatcacaatttgctggagtaaaaacctgcatgggaaccagtgctggggtaagaaaacctaaactataattgacaaattgctggaggctcagtgtggacaagtctgagttaaaactccagggacacccagtcactggggatggggggcacactttcgtgagttcagttctaccaggctctcatactcaacactagagaaaaatctccttgtgcttctggcaaggggagaaggaaagaaactattctgaaatacacaagagccattctgttcctatacatttatttatttatttaagacagagtcctgttctgtcacctaggcttgagtgcagtggcatgatctcagctcactgcaacctctgcctcctgggttcaagtgattctcctgcctcagcctcccaagtagctgggattacaggcacacaccaccacgtctgattttttagagacagggtttcaccatgttggccacactggtctcgaactcctgaccacaagtaacccgcccacctcggcctcccaaaacgctgggactgcaggcaagaaccatcacgcccagccgccattctgtttttcttaacatcacctgtcctcaggggaaaccattttaccagagcctaaccttcttgggttctatgagagcctaactaaccttgggaagagaaacacccaactccagcccactccaatcatcctgtcctacctaaggagggaaggtgctgaagtatttgtgaagttcacagtccaggggcacaggctcaccaaaggactgaaacctaatcataggtctatagaatgcttctcctgtctccacaccttaccaccacaaaaccaaacgcctatttaccatcagtccttttactcagtacaacacgcctggctatcaagaaaaaattacaagccatactaaaagaaaacacagtttgaagagacagaacaagcatcagaactagactaggcagagatgttggaattatcagattaggaatttcaaacaactaggattcatatgctaagggatctaatgggtaaagtagacagcatacaagaacagatgaacaatgtaagcagagacatggaaagtataagaaaacagaaacaaaaagaaaatctagagatcaaaagcactgtaacagaaattaggaataaatttgatgggcttactagcaaggctggacacacctgacaaaagaatctctgagcttgaaaacatcccagtagaaatctgaaactgaaaacaaaaagatactgaaaaaaacaaaacaaaacacggaatattcaagaactgtgagaaaaccacaaaaggtgtaatacatacataatggtaataccagaaggagaagaaataaagctaggaacagaagaaatatttaaaacaataatgactgagaatttcccccaaattaatgtcagataccaaaccacagatccaggaagcacaaagaacagcaagcaggatgaataccaaaacaaaacaaaatgaaaaataccttgacataccatatttaaattacagaaaattcaaagatgggccaggcatggtggctcatgcctgtaatcccagcactttggggacgccgaggtgggtggatcacctgaggtcaggagtttgaaaccagcctggccaacatggtgaaaccccatctctactaaaaatacaaaaattagccaggcgtggtggctcacgcttgtaatcccagctattcgggaggctgaggtacgagaataacttgaacccgggaagcagaggttgcagtgagccgaaatcatcccactgcactccaacctaaacaacagagcaagactccatctaaaaaaaagaggaaaaaaaagtaaatggatggaaaaagatgtaccgtgctaacaccaatcaaaagaaaacaggagtcgctatattagtttcagacaaagcagacatcacagcaaggaaagttttcagggataaagaagggcactacctaatgataaaggggacaattctccaagaagacataaccatctttaacatacttgcacatagcaagagtcaaactacatgaagtaaaactaacagacctgcaaggagaagtgattaatctattattatagttggagactttaacaccaatctatcagaaataggttcagcaagcagaaaatcagtaaggacatggttgaattcaacaacaccatcaattcactggacacaagggcaactactgactacttcgtccagcaccagagtacacatttttctcaagttcacataaaacactcaccaaaatagacagattctgggccataaaacagtatcttaacaaaattttaaaaacagaagtcatacaatgcctgcttcccgaccacaatgaaattaaacaaaaaattaataacaaagatagctggaaaaatcccaaaatacttggaaattaacacatttctaagtaacacaggggtcagataattcttcaagacacaattttaaaatattttgaactaaatgaaaatgaaaacacaatttatcaaaatgtgtgagatgcagtaaaagtagtgcttaaagagaaatagcattgaatgcatatattagaaaaggagaaaactctataatcattaagcttgtaccttaggaaagtagaaagagcattaattaaagaataaaattaaatccaaagtaagcagaagacaaaaataattacagcagaaatcaaggaaatgaaaaacaagaaatcaatagagaaaatcaatgaaaccaaaagcgaatgctttgaaaagttcaataaggctaggtgtactggctcacacctataatcctagcactttgggaggctgaggtggacagatcacttgaggtcaggagtttgagactcgcctggccaacatagtgaaacctcgtctgtactaaaaatacaaaaattagctgggcatagtggcagatgcctgtaatatcagctactcaggaggctgaggcaggagaatcacttgaacccaggaggcagaggttgcagtgagccaagatcatatcattgcactccagcctgggtgacagagtgagactccgtctcaaaaaaaaaaaaaaaaaaaagttcaataaaattgataagcttctagccaagttaagaaaaaaagagaacacacattattaatgtcaaaaatgacatatttcatatttcatggacattaaaggataataatgaaatgctatgaacaactctatgcccataaatttgataaccttcatgcaacggaccaattccttaaaagacacaatctgccaaaactcatacaagaagaaatagataatccaaataggcctatatttatttttaaaattgaatcaataattggtaactttccaaacacaaagcaccaagctcagatgggtttagaggtgaattcaacaaaacatttaaagtggaaattacactgattttctataatctcttttagaagatagaagcaaagggaatacttcccaattcatcctgaggccagtataccttaatgccaaaactagacaaagacatttatttatgagaaaacaacagataaatatctctcatgaacatagatgcaaaaatcctcaacaacgagatgcttggtggtctgtggttccggagcttcctcgggatgtcagtggactggctgaggggcaaggtggaagtcaatcaagagactatccagcggctccttgaggagaatgaccaactgatccgctgtatcgtggagtatcagaacaagggcggagcgaacgagtgcgtccagtgccagcttgtgttacacagaaatctcatttatttggctaccatcgcagatgccagcccaaccagtacttcaaaagcaatggaataatctttcaaaagcaatggaataaccttccagttggctgttgtgagtagtaattgaatgtaatccatctcttacaaaatggagacaggatctttaccaacttaactgcttaaaacgtgaatgacacttctgtggctctatttaaaaatgtgaaaatgtggaaagggcgcggtggctcacgcctgtaatcccagcactttgggaggccgaggtgggcggatcatgagatcagcagatcgagaccatcctggccaacaccgtgaaaccctgtctctactaaaaatacaaaaaattagccgggcgtggtggcgggcgcctgtagtcccaatcactcggggggctgaggcaggagaatggcgtgaacccgggaggcggagcttgcagtgagttgagatcgcgccactgcactccagcccgggcaacagagcgagacgctgtctcgaaaaaataaataaataaataaaagtgaaaatgtgaagaaagctaccaacttaactgtattctcaatgtaaatatttttaaaataattaagcaaatccctcaataagttgagaccagatgtcctctttcctgaacttggagcatatttggataactaagacattactaggatgttcaagcctactttttagtttcaacctgaagaggaagctgagtaggtgttgggcaggaattggtgagactccttgacttgagaccttgctaaatggacatttatctgcgtgctccttcctaacagttgtaaatgtggtcccccgactgctgttttcagattgctttgaaataaagcttagttttctacaaaagaaaaaaaaatcctcaacaaaatattagcaacttgaatgcaaaatgtattaaaaaaattatacactgcaagcaaatggaatttatcccaggtatgcaaaactggttcaatatttgaaaatcaatgtaatccatcacatcaacaggcaaaagaagaaaaatcacggctgggcatggtggctcactcctgtaatcccagcaccttgggaggctgaggcaggcagatcacaagatcaggagttcaagaccagcctggctaacatggcaaaaccccgtctctactaaaaatacaaaaattagctgggcatggtggtgcgcacctgtagtcccagctactcaggaggctgaggcaggaaaatcatttgaacccaggagatggaggttgcagtgagccgagatcacgccactatactccagcctaggcaacagagcaagactcagtctcaaaaaaaagaaaagaaaaggaaagaaaaatcagatcaatagatgcagaaaaagcacttgacaaaatttaacagaaattaatgaagttctttatcaacttgataaagaacatctacaaaaatcctacagctaacttcatacttagaggtatgaaactagaagctttcctgctaagatcaggaacaaggaatggaagtctcctctgactactcctttttcaacactctagtggaagtcctagctaatgcaaaaagacaagacttaggtaataaaaaaatatactgattgagaagaaagaaataaagctgtttttgttcacagatgacacaattatccatgtagaaaatccaatagcaatgaccaaataactggaaataataagtaattctacaaaggttgcaggatacaatgttaatatacaaaagtccattgttcttctattactagcaataaacaagtgaaatttgttttgatgttgttgttgctgttgttgttgttgtttgatactgagttttgctgttgtctcccgggctggagtgcagtggcgcaatctcagctcactgcaaccaccacctcctgggttcaagcgattctcctgcctcagcctgccgagtagctggcattacaggcacccaccactatggccagctaatttttgtattttcagtagagacagggtttcatcatattggccaggctggtctcaaactcctgacctcaggtgacccactcacctcagcctcccaaagtgtggggattacaggcgtgagccaccgtgcccagccttttttttttttggaaatttgaaattaaaacatattatgtagtaccttttacattagcacccccaaaagtaaaatacttaggtacaaatctaagaaaacatgtaccagtcttatgtgaggaaaactacaaaactctcatgaaagataccaaagagaaactaaataaatggagagatattccatatttaccaacaggaagactcaatattgtcatgttgtcagttctttacaacttgacttaaagagttaacgcaatcccccatcaaaatatcagcaagttattttgtgaatatcaacaaactgattctaatatttatatagcaaagcaaaagacctacaatagccaacacaatattgaaggagagaacaaagttaggaggactgactctctccaacttcaagacttactacaaaactacagtaatcaagaatgtagtgttaaattagccaggcatgatggtgcatgtctgtagtcctgcttgctactcaggagactgaggtgggaggatcacctgagaacaggaggtcagcgctacagtgatcatgccactgcactccagcctgagcaacagagtgagcccttgtctcttaaaaaaaaattttaaattaaatttaaacaaatattaaataaaatgaaaaagtaaagattgtgtggtattgacaaaatgatagacaaatagatcactggaacaaagtagaaagcccagaaatagacccacataaatacagtcaattgatctttggcaaaggagcaaaggcaatacaatagaagaaagatagtcgtttcaacaaatgctactggaataactagacatccacatccaaaaaaaaatgattctagacagactttacacccttcacaaaaattaactcaaaaaggatcatagacctgaatgtaaaatgcaaaactatgcaactcctagacagtaacataggagaaaatctggatgactgagggttttatgatgactttttagatacaacaccaaagacatgatccatgaaaataagaattgataagctggacttcattaaaattaaaattttctgctctgaaaaagacatgccaagagaaagaaaagacaagccacacaccaggaggaaatacttgcaaaagacttatctgataaaggactgttattcaaaatacacaaagaatgcttaaaactcagcaataagaaaacaaacagcccaatttaaaaatgggcaaaagacctgaacagatgcctcaccaaagaagatacacagatggcaaataagcatatgaaaagatgctccacatcacacgtcaccagggaaatgcaaattaaaacaataatgagataccactgcacacctattagaatgaccaaagttcagaacactgataacaccaaatgctggtgaggatgtggagtaataggaactctcattcattgctggtgggaatgcaaaatggtacagccagtatgaaaggcagtttggcagtttcttataaaactaagcattctcttaccatatgatgcagcaatcacaccccttggtatttacccaaaggagttgaaaacttatgtccacacaaaaacctgcacacaaatgtttatagcagctttatttttagttgtcaaaacatggaggcagtgaagatgtcctcagtaggtaaatggataaatagactgtggcatatccagagagtggaatattattcagtgctaacaagaaaggagctagctggccaggcgcagtggttcacgcctgtaatttcaacactttgggaggccagggcaggcagattacttgaggtcaggagcttgtgaccagcctggccaaccaggctggccaacatggtaaaaccccatctctactaaacatacaaaaattacccaggcatggtggtacgcacctgtaatcccagctactcgggaggctgaggcacaagaatcacttgaacctggcaggcggaggttgcagtgagctgagatcgcaccactgcactccagcctgggcaacagagtgagactccatctcaaaaaaaaaaaaaaaagaaaaagaaaaagaaagaaaaaaaagaaagaaacgagctatcaatccatgaaaatatatggaggaaacgtaaatgcatatgaagtgaaagaaggcaaattgaaaaggtcacatcctatgtgatttcatctgtatgacattcttgaaaaggcaaactctcgagacagtaaatagatcagtggtttctaggaggcagaaggaagggacggatgaacaggcagaccagaggatttttaggccgatgcaactattctgtgctataatggtggatccatgtcattatacatttgtccaaacccacagggtgggcaacaccaagagtgagccctaaagtaatctatggattttgtgtcaatgtaggttgatcacgtgtgacaagtgtaccactctggttgatgctgataatgggggaagccatgcatgcctgagggcagagggtatatgagatatcttcctaccttcctcttagttttgctgtgaatctaaaactgctcttttaaaaagtctaaaaaagaaaagaaaaaacaggccagacatggtggctcacccgtgttatcccagcactttgggaggctggggtgggaggatcacttgagcccaggagttcaagaccagcctgggcaatatagcaagaccctatctctatattattttttttaaataaaaaataaaattcaaattaaaaaagcaataaaaaacatcctcaacgcttttcttacatcatatactaaattaacttgatgatggacctatgtataaatgctaaaactatcaaatttccagaaaaatctccctgtctctctttttagagacagggtcacccaggctggagtgcagaggtaagatcatactcatagtagcctcaaactcctgggctcaaatgatcctcctgcttcagcctcccaagttgctgggactacaggtgcacagaaaatctattcttacttggagtaggcaaagattatttagatagaacaaaaatatcaacctacaaaagaaaggaattgataaattgtactttatcaaaattaagatcttctgttccttcaaggccattgaaaataaaatggcaacgcactgaggaggaaaaatattaatatttgcaacacatgtatctgacaaagaccatgtttccagagtatatgaaggactcttacactcaataatgataaggcaaaaaaaaaaccctttatttgcttttgtttttttgagaaagggtcttgctctattgcccaggctggagtgcagtggcacaatcatagctaattgcagcctcaaactcccagcctcaagcgatcctcccacctcagcctcacaaagtattgggattgatggtgtaagccactatgtctggccccacctaatttaaacaaggtcaaaagatttcaacggacattttacaaaagaaaaaataggaatggctaataagtccatggaacgatgttcaagtatcattagtcatcagagaaaagtacattaaagcacaatgaaaactgtacatactcaccggaatggctaaaactgaaaagactgaccaaaccaaatgttggtcaggatgtgaagtaacaaaaactctcgtaaatggctcgtgggaatgtaaaatatggaacaagcaatttggaaaacaactcagcagtttctgataaagttaagaatatgagccgggcacggtggatcacctctggaatcccagcactttgggaggccaaggcagggggattacttgaggtcaggagttccagatcagcctggccaacatggtgaaatcccatctctactaaaaacacaaacattagcgagggaaaaacacaaaaaaatagtctgcagctgtagtcccagctactcgggaggctggggcaagagaatcgcttgagcctgggaagtagaggttggagtgagccgagatcgcaccactgcactccagcctgggcgacagcaagactccgtctcaaaaaaaaaaaaaaaaaaaaaaaaaagagaataagcttataatatgatccagcaattccactcctaggcatttacccaagaacaataaaaacacatgttcacagagacttttacatgaatagtcctagcagcttcatgtacaatagccaataactgtaaacaacccacatatctcccgactggtgaatagatacacaaattgtgatacagacaatggaatgctacccaacaacacaatgtaaaacattgatgcaggctgagcgcagtggttcacgcctgtaatcccagaactttggaaggccgaggagggaggatcacaaggtcaggagatcgagaccatcctggctaacacggtgaaaccccgtctctactaaaaaaatacaaaaaattagccaggcatggtggctggtgcctgtagtcccagctactcaggaggctgaggcaggagaaaggtgtgaacccaggaggcagagcttgcagtgagctgagatcgagccactgtactccagcctgggcgacagagcgagattccgtctcaaaacaaacaaacaaaaaaaatactgatgcaaaaaaccacatagaacagtcttaaaaattttctgcataaaagcagcaagacacaaatgagtacatactataggattacatttaaaagaaattctagaaaaagccaaactaatctataatatagttgctgcctgggttgtgggggagttgagattttctgcaaaaggacatgagggaactttctggagtaatagagatgttcttttttttttttagcccaaaagtgaaaatactgattgattttattttattatcattatttttagagatgaggtctgactctgtcacccaggctggaatgcagtggcaccatcatggctcactgcagcctcaacctcgcagcctcaagccatcctatcacctcagcctcccaagtagctgggactacaggcacatgccacaatgcccagttaactttttgtattttttgtagagacagggtttcaccatattgcccaggctggtcttgaactcctgaactcaggccatctgcccacctggcatgtgccacactgcatctggcctggaaatattctacatgttggttgtaaggatgaatacacaaatgtacaaatgtatcaaaactcatctatttgcacactttaattgggttcattttctttgtaagttgatttaaggaaagatcaggccttgtcttccttctactatatggttagctatggggaaactctacccctgaagcaatgagccttagggagtgactgtgattgcctagctctgactgtgattagattatattagggcgaaattgtagggaaattgatctgattgtagatctgagctacatttttctttttttattttttttagacagactcttactctattgcccaggctggagtacagtggtgtaatctcggctcattacaacctctgcctcccgggttcaagtgattctcctgcctcagcctcctgagtagctgggattacaggtgccatgcctgggtaacttttgtatttttacaggggtttcaccatgttggccaggctggtctcgaactcctggccttaagagatccacccgcctcggcctcccaaagtgctgggattacaggcgtgagccagcatgcccagctaagctacacttttcattatcaataataaaagaggtaccttcagaagtactatacaacttgctgattcagacatttatttctgttcagatccctcactctcctcacccatgctagaatgtaagctccacaagagcaagacttttcatttacttttgttcatagcacatagtacatgtcaaaaagatatgatagatgcctatctgtcatcttctgtgtcttacttctcatttcactccgaactcagaagggaaagatggcattgttatttgtctcctaaaattccaacactcttttttttttttttttttttttttgagacagattcttgctctgccacccaggctggagtgcagtggcgtgatctcagctcactgcaagctccacctgccaggttcatgccattctgctgcctctgcctcccaagtaactgggactacaggcgcctgccaccacacctggctaattttttgtatttttagtagagacggggtttcaccgtgttagccaggatggtctcaatctcctgaccttgtgatccacctgcctcagcctcccaaagtgccgggattacaggcgtgagccaccgcgcccggccaacactgtcctcttacagatagtaacgacagcctaacaataaaccataaatcagccaacatctactgggtacttaatatgtgtcagttttacacaatgtgtaaaaatgtgtatatacattttttcaatcctcataatgacctaatgaaatgggtactattgagatttccattttggaaatgacaaaaccaaggctcagataggttaagtgactctcccatggtcacacacttagtaggtggagaactaaattttgattccaagtaagcgaatcccaaaatgatggctctacacactactgtttccattcttccctggctccagtccattgtcctcacaacagcctgagcaagatttatgtttaaaatcaacatctggggctgggggcggtggctcacacctataatcccagcacttgggaggctgaggctggcagatcagttgaggtcaggagtctgagatcagcctgggcgacatggtgaaatcccatctctcctgaaaatatgaaaattagccaggtgtggtggcaggtgcctgtaatcccagctacttgggaggctgtggcaggagaattgcttaagcccaggaggtggaggttgtagtgggctgagattgcaccactgcactctagcctcggtgacagaatgagactccatgtcaaaataaataaaaataaaatcaacatctgcctataaagcccggcacaacctgcccctgccatcctttccaatgtcatgagggagcaatttacccctcacttacctcactgaagaccatcctgatcttactttgggttcatcacatggcttcctgcctcaggaccttggcacatgctgttttctttgcacagatccctccctcaccccgacacaactcattcctcaggctctgttaaaatgccacacttttggagaggcttccttgacccctcttttccaaatccaaacagacctattactctttcattttaacctgggttttacagccacagcacttgtcacaatttgaagttatcttcctatttctgggtataactggtatatcctgcttcaccagatgaagtgaaactaattcatactgccttcttcaagtcagaactggctctcgtttccacttgccacatttccaggaagcttgttacctctcttgagtttttctcctatcacattgccccaaaacttcagggattttcttagcttgaaggagtcaattctgatctcaaataatttgacaagtataagatagagcctctgatcagttcacaagtttactgtttttgttttgttttgtttttaactgttattgctcctcatgttgttaaaaactagccctggccaggcccactggctcacacctgtaatctcagcactttgggaggctgaggcaggaggatcacttgagcccaggagtttgagatcagactgggaaacatagtgaactgccccccatgtctctataaaacatagaacaattagctgggcatgctggcccatgcttgtagtcttagctgtgtgggaggtgaaggagagagggtcgcttgagctcaggaggtcaaggtccagtgagctgtaactgcaccaccatagtgagactctgtctctaaatttaaaaagtaaaataaataaataaaaataaaattggatggcttcgagagacctgctggcagagagaacacctagggtcctgaggggaagctcgcgaggagggaagaggcctcaggtcaccctcctgcagccaatgcttcagggagaaacaaggagtcagccagtagtttacagatgagccctggggagacaggtaagggagtcgggagtcaagcagggatgtgctctctggaaaagctcccagggggtagtagcttcagctggatcccacagcggacttgggtgtcagtttaccccaaacttatctacactctgaagtgaaagggacagggccacaaaactgatagaaaggagtcttagtggatctgagcagaacctgaccgccaaatgctgcaaaagggaatcctgcaaactggagagtgggatgaagcgtggggacctggacagtcagcgtgggtgtaggaggtgggggccagggagatgaccttcatccagtctggggctaagccacccttgaacctctcacccagacatggtgaaacctctttggaaaccactgctgaccaggtcaatatcttacctaagtagaactggaagtcccaggggatgagctgtggcccaagaacaggggacagtgtgtgagccaccatgcctgttgtgagccactgttcctggctctgtctccatttgaaaggttctaaaacactgcgtctaccataaagctctcctttcatttcttcccagtaagttccttggcctctatccaagtgtgcccacctcctccctaaggctctgattaccaggaggaattaggaaaagcagcttctgtcaagccacacacacacaaatgcctttttcattccttgccctcgagtcatgcgtgcccacttaccctctcatgaccaagaagggctacccaagtgcttctttccaacacaaaggcaatttgctcccaaataattgagaatgtccctagaaagaaactgtgagaaacttttaaatagaggctcatttcagattttaaaagaaaagaatactgcttactaagtgttcacaagctgcatatcggtctgcctggcttaagcctcaggtcttctgcttttttgtaaacccagggcttcccatgatgggcattcaatatgtattcgttggatgaatgaatgagtcaccaactcctgaataaaactatcagtaaactaggacaagagtttgagaaccaaaaaattaacagaattatctcatcattgtataaaatgctgatcattggtggatatgtatgtgtgcatatacatgcaattttacagaagttttcttctttttaaagaagagctcctcgggccagacaccatggctcatgcttgtaatcccagcactttgggagaccaaggtgggtggatcacctgaggtcaggagttcaagaccagcctggtcaacatggtgaaaccccaactctactaaaaatatacaaaaattagccaggcatggtggcgggctcctgtagtcccagctactcgggaggctgaggcaggagaattgcttgaacccaggaggcagaggctgcagagccgagatagcgtcactgcactccagcctgggcagcagagcgagactccatctcaaaaaaaaaaaaaaaaaaaaaaaaaaaaaaaaaaaggcctttctttgtattttgaaattctaaaaaaaagatttcagacattaaaaatggcttaaaaagtaatataagaaacaccaggaaaccaactataaagcttaagaaataacgtggctgggaacggtggctcatgtctgtaatcccagcactttgggagactgaggtgggaggatcgcttgagcaagaggtcaacgctgcggtgagctatgattgcaccactgcactccagcctgggcgatagagcaagaccctgtctcaaacaaaaagtagtagaagccacctgcgtatgccttctcactttctttcccacccgaaggaaccattgtcttgagttaaagaaacttctgcagtcctgggagggatggctcaacatgctcaccttttcctctctaatcacaggttattaagccaaggtggacacctggcacacctgtgccaatcagtttcttcctcccaggaatttacaaatgagagcctgagctaatttgctgtgatgagcaaaactgacaggtcatgctaatttcagggctcagacttttttctaggggtgtggccatcatgagccctgtgcaagaagagtatgaataattggaagaaaaaagaagacagagcagacacacagagaaaagaaaaggaggagaggaaagagggaaagaggcttttttttttgccttatttctaaatcatttcccaattcccctctccacccctctaaagcctgcctgcttttgctatttctgatttgtgagagttctttataaccttcccatgacctccgcttttccttgaactagtatggatggattctatgatttttaactcaattatccttaagatacgctttccccaccaaaaaaaaaaaaactttattcactaattacaagtggacaaagttcctaggatcatataacttttttatttttaagttcagtggtgcgatcctagcttactgcagcctcaaacccttgagctcaagtgatgtccctgcctcagctgcctaactgggactacaggtgtgtgccatcacacccagctaacttaaaaaaaaatttagaggctgggcgcagtggctcatgcctgtaatcccagcactttgagaggccaaagtgggaggatcacttgagcccaggagtttgagaccagcctgggttacatagtaaaaccccgtgactactaaaaatagaaaaaaattagccgggcatggtggtgagcacgtgtagtcccagctactcaggaggctgaggcacgagaatcatttgaaccctggagacagaggttgcagtgagccaagatcataccactgtactccagcctgggtgacagagtgagactctgtaagaaaaaaaaaaaaaattttttttttctttttttaagagatccacccaccttggcctctcaaagtgtttgattacaggtgtgagccaccgcgcctggccttttttttcttttacttttagagtcagagtattgctttgttgcccaggctggagtggagtggtataatcatagttcactgaagcctccaattcctgggatcaagcaatccttctacctcagcctcccaagtagctgggcccacaggtgtgagccatcaccatgcctggctaattagaaactttttttttgtagagacggggtctcactgtattgccaggctggtctgaaactcctgctctcagaagacccttctgctttggactcccaaagtgctgggattataggcatgagccaccatgccaggcccaaaaggtttttttgttttttttttcctgagaaagggtctcactctgtcacccagactagagtacagtggcacaatcttggctcactgcaacctccaccttccaggctcaagtgattctcctgcctcagcctcccgagtagctgggattacaggtgcgaaccactaccgccggctaatttttgtatttttagtagaaacgaggtttcaccatgttggccaggctactcttgaacttctgaactcaaattatccacccgcctcaacctcccaaagtgctggggttacaggcgtgagccatcgtgccctgccacacagtctttatcaagcttataaggtcagagatgtgcagatccctggttacctctttgacctcattgcaccattctccccatcctgtcttggcttgaaagccccctgcagctgccgtcccttaccatttccagcacaccatcagggcctctgcacttagagacttcagcctggactgcctttccgcaggtagttgaatgactaaccttatgttgttccctgcttaaaggtcctctccaccaccctgtggcagactgccacagttactacttgagaccatcaccacgacggttactactgttactacttgagaccctcattacgtcattaagagactgaacaaaaggacgaatgtagaaatgaaaacgtaagacaaactgttttaaaggaagcggcctggggaagaagaagagagcaccctgcttctagtgagcaaaggcagcagcccctgggcttctacagcccttcgtatttaatgggtagaaagagcagggaggaggaggtaatgattggtcagctgcttaattgatcacaggttcatattattactaacaggcttcagatgtacctagtcacaagaaacactgcgcttggggcgtgactgccctcagcattccttctgggtggcagacacagtttgtcggtctgccaacattctgcatttttgagaaacagtttgctgcttactcatatagcctccagtgatatactgagttgatcacgaccctcaatctttccgcctccaacaccaccccatttaaaatatcagccaccagccaccactctctatttcctatcctgctctacttcttagcatttatcatcacctacgtggcaggagccaaaataggcgatagctaaaatctcagcaactgggggtgctgaggtgggaggatcctttgagcccaggagttggaggctgtactgaattatgatcgtgccactgccctccagactgggcaacagagcaagacccctatctctaaaaaaaaaaaaataataaatattatcacctatatctatgtctatatgtagatctctctctctctctctgtatatatattttttgagatagagtcttgctctgttgcccaggctggagtgcagtggtgcaatctcagctcactgcaacccctgcctcctgggttaaagtgattctcctgcctcagcctcctgagtagctgggattacaggtgcctgccaccatgcttggctaattattgtatttttagcagagacggggtttcaccatattggccaggctggtctcgaactcctggcctcaagtgattgcctgcctctgcctcccaaagtgttcggattacaggagtgagccacaacgcccggcctctttctgtatatatgtttgtttagtttgccctcccaccgccaccaccccccccattaaattgtaagctctataaaagcagggatcctgtcaattttattctctgctgtatctgtggtgactagaacaataaaaggtactcagtaaatatttataactggaacaaaggaaacaggtatgtttcaatgggagagaagaggtctggtgttgcagaggtagagggagtccctgtagggtctctcagttctgccactaatctctagctgagtgactccgcacaggttgtgtaacctctctgaacctctgtcttcatctgtcaaatggtgatgataacagtacctgttcacgcctgtaatcccagcattttgggaggccgaggcgggcagatcacgaggtcaggagatcaagatcatcctggccaacattgtgaaactccatctctactaaaaatacaaaaattaggtgggcatggtggcatacacctgtagtcccatctactcaggaggctgaggcagaagaataacttgaacctgggaggcggaggttgcagtgaaccaagatcatgccactgcactccagcctggcgacagagcgagactgtcaaaacaaaacaaagcaaaacaaaaacacacaaaaaacagtaccccgtgagctacagaaagttgttgggggtattagctggagtcctgggttgagtgaagtgcctggaagtgagaaatagcagctatagtgactgtgtattgtgttagcaggggaggggagccaagactcagaacccggatgcttaggggagggcaaccttcctgcaggaagggagaggacaagggggaggtcctgggcaaagctcagaggctgcaggcagggtatctgggctggaggcacaggttgctggatgatgatagctggcaatctgggtcacatcttttcttgaaaatcagtttttcctatctcccaacctcatagggtttctttgaggatcaagaaaatgtattgcatacaaagaagctctcttcaaaccataaagcactgcataaaggcttttatgatgatttcccaattttgcccatggctggctggataaatacatacccgtcctgtccctctcagcagaagctgctttattcccctgaaactcatgttcctggggcctggacaggtagggacatggatggttatctgcatctctctctgctccaaagacccaatttcccccaatcaattttatgttattttaagcctgtcttaatatgggctcttagcagaaaaaatgcacttcttctattattcctttatcatattataatgcctttaggagatattatttacttttgaaaaatggctaggtttttctaatataaacattatcctgacctgttgatagaatccctttgttcagtttatcctgctaaatatatatatgactttggcccatttttactcctgtaatcctctctctagtctaacctccacagcatcattatgacataaattgtggaactgctttcttttactcaccattattcatgccttcatttgatcatttgttcactcaacaaacatctatagagtgcccacaatgtgccaggcactgtagtattgaggttaagcagctaacccaacagatttaatcatcagaactatgaaggaaaataaatcaggggatggggtcgagggttttgactataggggtttcaacattaactagggatggcctgaaagggctcatgtgaaggtgacctttttttttttttttaagcaatgaggtcttcctgtgttgcccaggctggcctcaaactcctgggctcaagcaatcctccacatcagcctctcgaatagctgagactgcagatgtgcaacaccacactctgctcaaagtgacatttttgtaacgatgtgaaggaattagaggacagttccagtatcttgcagaggaagtgggaacagcaggtacacaggccctgggaaaatgagttgggagagaaaacatcgaggaaacagaatgaggagggggcacagtgggagatgcgtgctcatgggagggaatgtgcagggggtcactgtcaagactgactttctttcttttttttttttttttgagatggagtttcgatcttgttgtccaggctggagtgcaatggcgcgatctcagctcactgcaaactccgcctcctgggttcaagcgattctcctgcctcagcctcccaagtagttgggattacaggtgcctgccaccacacccagttcattttgtatttttagtagaaacggggtttctccatgttgatcaggctggtctggaactcctgacctcaggtaatccgcctgcctcggccttccaaagtgctggcattacaggtgtgagccaccgtgcccggccaagactgacttactttctgagtgaaataggcagctgtgcagaggttctggtgttaggagtggcacaatcagaccaacactgtcacagggtcaccctggctgttctgttggtgatagtctgaagcagagctgttcttcagccagtagagactagagcctggcattctttctgcctttgttttgttttgttttgttttgagacagagtcttgctctgttgcccacactggagtgcagtggcacgatcttggctcactgcaacctccgcctcctgggttcaagggattctcctgcctcagcctcccaagtagctgggattacaggcgcctaccaccatgtctggctaatttttgtatttttagtacagactgggtttcaccatcttggccaggatagtctcgaactcctgacctcaagtcatccaccggcctcagcctcccaaagtgctaggtttacaggcgtgtgccaccacacctggctcttcctgcatatttttacagcaccttggtctgaaggagacaagcgtgcacacagggagacagatcaatcagagagccatggcaaccatgcaagtgagacatttgggtggtggggaccacggaggttgcagcaaatgtggtgagaaatggtcggattctggacatgtcagttattatactggaaatgtgacttcactagtatgacatccattgggtttaaatcattcatactgaacactcagaaagctagcatccattatttcctgtggatcttttcccgtgatgtctcatcccaaattccacccaacaatttcgtgaagccactttctcccaccttttggactccacagacacaattcctctgtgatacctttccttcctcaaaggcctggccggggaccctgcttcccaaatggacacacttcccacggtgtacctcagcctctggctccctaaccttctggattttttttttcttttttactttttttgagacagaatctcactgtgtcacccagactggagtgtgcagtgctgtgatcttggctcactgcagtctccacctctgggttcaagcaattctcctgcctcagcctcccgagtagctgggattgcaggcgtgtgccaccacgcccagctaatttttgtatttttagtagatacgaggtttcaccatgttggccaggctggtcttgaactcctgacctcaggtgatctgcctgcctcggcctcccaaagtgctgggattacaggcatgagccagtgctcctggccccttctggatttcattgacattacaaatgcatgtgctttgacttgaaaatgaaacaaaaatactcttcattttctctccaaaagcttgactggttaaagctgatcaagggtgaaaatggcactttaaaagtcatcaacctaagtgtgtaacctaaattatgccattggctacacgaagtggggtttctacatgaaacaccgtgatagagagtggagctggatgctgtgtgatgttatcagccaagctgccgtctccccaggactgcaacactcaggacaccaccaggcattttgctctcagtagctttaaatatccttagtgatggtctaatgtgactcccacaggaacaccgtttgctgctttcttttgtagttcttagtaataggagtccttttttttcccctaacaacgaatgcacaacctgatcttgtgtctttgtttcccacattgcatgcatttcatgctgtcgtgttttgtgttcttattttctaaacaagtagaaaaaagaacagagatctacaggtgtaaatacatgcctataaaaccatccactatcctgagggtggataataataatactacaaactacgaaattgattatatgtcactgagagttgtcaactccttacattttattccagtatgttccatgaatagaaccgggaaaattttaaatcccaattaaacaacactcattttctgacccaaaccaaactgagcttcctttcctgtttccccagagaatataaacagatacagttaaactgccatggagccattattttttttttaattgtgagacagagaaaaaaaaatacccaacaaacctttctccttttcagttttgctttatattcttcatatacttttaatgttgtttttgcttatagcaaacaaatataataatgataataacaggccggacacagtggctcacgtctgtaatcccaacacttcaggagactgaggtgggtggatcacctgaggtcaagagttcaagaccagcctggccaacatggtgaaaccccatctctactaaaaatacaaaatttagctgggtgtggtggcaggcgcctgtaatcccagctacttgggaagctgagaaccgcttgaacctgggaggcagaggttgcagtgagccgagacagtgccattgcactccagcctgggcaacaagagcaaaactccatctcaaaaaaaaaaaaaatgctaataacaaaatcaaccacctacaacccacactcatgtcattaaccttgagtcatcctggggtggcagggggtggtgacaatgagacaagtgttctacttgaatcccgttccatcacttgataacttttgggttttattttatttttttttttagagatggggtcttgctctgtcacccaggctagagtgcagtggcacaatcatagttcattgcagcctccagctcctgggctcaagcaatcctcccagctcagcctcctgatccctgtggtcagatggaggatactgtgattgatcagatccacaagaaatgggagagaggtgagtcccctaagtaagtgatgcttacagacaaatacaacatagtcacctccattccaaaaccataacctcaacaaaagaaaacataaagtccactgcttgtgtgaggtagaaaagtccaccagggccaggcgcggtggctcatgcctgtaatcccagcactttgggaggctgaggcgggtggatcacgaggtcaagagatggagaccatcctggccaacatggtgaaaccccgtctgtactaaaaatacaaaaattagctgggcgtggtggcatgcacctgtagtcccagctacttgggaggctgaggcaggagaatcgcttgaacctgggaggcggaggttgcagtgagccgagatcgtgccactacactccagcccaaatgacagagcaagactccatccaaaaagaaaaaagaaaagaaaagaaaaagaaaaatccaccagaacttccttacttagacaactttacttctttgtaaggttgtttgcttttgctcattgtaaatatcattccataatataagcagcagagactcaagggttaagaatctacctaactaaactatcaatcaaacaggaggtataataaagacatttttagactggtaaagtttcaaaatattatgtcttatgtactatttcttaggactatcctagaagatatatctcatttaaatgaggaaataatttttttttttttttgagacagagtcttgctctgttacctaggctggagtacagtggcacaatcttttctcactacaacctctgcctcccgggttcaagtgattctcccgcctcagcctcccaaatagctgagactgcaggtgtgcaccaccacgcctggctaatttttatattttttgtagagacggggtttcaccattttggccaggctggtctcaaactcccgacctcaggtgatccacccaccttgtcctcccaaagtgctgggattataggcataagccactgcacctggccaggaaataaatttttaagaagattacgaatatcctagaggatatacctcatttaaaagagggaatacactaaaaaaaaaaaaaagacacaggatgaagacagcaggaagtccagcacaggaggtggagaaggaacccccagggtggtgggaaaagcctcctgggatgacggctccacagagagcaaccaggacagagggggagctggaggcggggcgtgcaagaaagatcaagaattctcaagggagaaaaacagtaagataacaataaaaataataaaaattattcaacaaaatattcaaataaaaattattcaacaaaataaaagccaatagataacaatgattctgaatttattaagggacttactgtgctgtgttgagaaagttagaaggtggcataataggcaaatgtgaaaccaagtgaacaaaaactcaaatgtagaaacaaagacgttcaaatcaattaccatctctaggggggaatagaacaagacaaaaaatgtattcatagtatactcaatggctctgttatgaagaatactatacagatcataaaatgtaaacaattaaaattaattaaacaaaaactgtgctataaccctattgataagattgggggtattgaatagcaatgtgtgtgtggagtggaaaataaataaatgcttttctccacttgcacccagtataattaataagttgacagagagaaccttttttattttttatttattttattttttgagacagactctcgctctgtcacccaggctggagtgcagtgatgcaatcttggctcactgcaacctctgcctcccaggttcaagcgattctcctgcctcagcctcccgagtagctgggattacaggtgcacaccaccaaggctggctaatttttgtatttttagtagagatggggttttaccgtgctggccaggctggtgtcggactcctggactcaagccatccacctgcctcagcctcccaaagtgctgggattataggcatgagccactgcgcccagccattgcccttttttttttttcaaatacacactatttgaagttttccccccactcagagaaacaacgttatattcagtgactttcaggtaataacaggaagtctctttttcaggtgctaaaagtctaatcgtgtctattctgatatcaaaacttcagtctagattttgccctgggtatattggacttgaatatagacacctcccccgtagaaaacaatgatcaaacccgaacatgacatgaaaagcaacgacgggaaagtcctggagcatgaacggaaggtgacggtggcgggtgaggagtgcagctggagtgctggtgcatgcagggagagagccagacaagcaaatcccatctctgtggctttttgcctgtggccgtgtgcagtccgtgtagcatgaaggccagtagacatggcaaatccacaggttttctggcatggggagcaagaaaaatgaagccagaaaaccaggaaagctgaagagaatgagagggtcccagagggaaacatttagaaatgggatgctcaaattatatctctcacagaccccagaggcacacatatgtgaaacaggcttaaagcagcccagctcaggaaattaaatctaaactgagaacacagctaccatccaagagatactcttcacgctaaaatttcctactaacacaaagggggaaaaacacgcattggagaaaaataacagaatccagaatctccacaatttaatatttgaattccaggatcaatccaaaattacctgtcatatgaagaatcaagaacatggaatttggccaggcgtggtggctcacacctgtaatcccagcactttgggaggccgaggcgggtggatcacctgaagtcaggagtttgagaccagcctggccaacatggtgaaaccccgtctctactaaaaatacaaaattagctgggcgtggtggcatgtgtctgtagtcccagctgctcaggtggctgaggcaggaaaatccttggacctgggaggcgaagtgtgcagtgagctgagatcgtgccactgcactccagcctgggtgacagtgcgagactctctcaaaaaaaaagaaaaaaaaagaaaaagaaaagagaaaatggaattcattctcaagaaaaaagagaatcaatcaagccacatcccaatttgaacccagttgaaactcacagacaggattttaaagtagatattgtaactactgtcagtaaagtaaaagacacatgttttcaactgaagaaagtctcagcaaatagaaaatctcatcagaggaaagactaaatgaaatgcaagataagtcaatcaaaattacccaggcctggcgtggttactcacgcccgtaatcccaacattttgggaggctgaggcgggaggatcacttgagcccacgagtttgaggctgcagtgagccatgatcatgccattgccctccagcctgggcaacagagcaagaccctgtcacagatacaaaaaaagaaaattgaccccaaatagtcatagacaaatattctagaaaagtcattgaacttttaatgaaatgataggcttttttgggcagcccagcacacaaaaatctagttatttacaaaaggggaaaactcaggctggccttggattcctttgtgtgttattttaacccatattaaacagtagaacaacactcacaagatatttaaggaaagaaagggacaagagcggcctgctgagcctaactgtccttaggtgtaagtctagagatgcagtttttgttttgttttgttttgttttgtttgttttgtttttgggacagtgtctgtcactcactctgtcgcccaggctagagtgcagtggtgcgatcctggctcactgcaacctccgccctgccgggttcaagcgattctcctgcttcagctacccgagtagctgggactataggtgtgtgccaccacacccggccaagatgcagagtatattgatccttgtgtcatccttaaggacactatttaaggactacttaaggacaatagggtgtctattttagctgagtaagaaataattggagtaatgagggtaagatactctgggtgggtcttgaatatccagagccacggaactaagactaaaacagatggggtggaaggagggtgacagaacagactgaaaatggcatatgcttggcaatgcagaaaggatgccaccgacacaaacagtgattggggaaatgaggtaagaaggaggataagctcatgaacatgtcatcagtagtaactggtcagctgggcgctgtcgctcacgccagtaatcccagcactttgggaggccaagctggatggatcacgaggtcaagatatcaagaccatcctggccaacatggtgaaatgccctccctactaaaaatataaaaattagctgggcatggtggcgtgcacctgtagtcgcagctacttgggaggctgaggcaggagaattgcttgaacctgggaggtggaggttgcagtgagctgagatcgcgccacttcactccagcctggcgacagagcaagactccatctcaaaaaaaaaaaaaaaaaaaaaaagtagaaactggtcgtcaaagggtaccatttaaacctggtcctttgcccccttgccctcagatccagtcctcacccctttgctgctctgatcagtgtcaagagaaggctgggccctgcaagctgtgtttcatagctcctgtgtctcctgttgtttttctgggtcagccatgtcaagacacaagaggacaactggaaagtgacaagaaggagagaagcttgggcaacattgccagtagcaggtgcattgcctctggggctaaagctcctaccccacaacatttttcttttcttttcttttctttttgagacagagtttcactaattttgtatttttagtagacaccgggtttcatcgtgttggccaggctggtctcaaactcctgacctcaggcgatccgcccacctcagcctcccaaagtgttgggattacaggtgtgagccactgcacccggcccacacatttttcttaggtcacagctactaccaggtaacccctgtccccaaacagtcacaccaccttctcccacccacctagaggaagtcatggctttctggtgttactaatctgtgggttcctacccggtctcatttggcttcttgactcttctaccacccatgtagccaatttcctgaattaaagtcaatcattagttttttgttgttgttgctttttcttttctttctttctttttttttgagacagcgtcttgttctgttacccaggctggagtgcaatggcacgatctcagctccctgcaacctccgcatcctgggttcaagcgattctcctgcctcggcctcccaagtagctgggactacaagcccatgctaccacgcccagctaattctttttttttttttgtatttttgtagagacgggtttcaccatattgcccaggttggtcttgaactcctgacctcaggtgatccacccgcctcggcctcccaaaatgctgggattacaggcatgagccaccacgcccagcctaaagcctttaaaacctaaagctttaaaggctttagtggggtttctgtttttctagaccctgactgatactaaaattgacagctcaagtaacaaaagtgtaaacatattaaaagaacaaaggttggccgggcgcggtggctcatgcctgtaatccagcgctttgggaggccgaggtgggtggatcacctaaggtcgagagttcgagaccagcctgaccaacatggagaaaccccatctctactaaaaatacaaaattagccgggtgtggtggtgcctgcctgtaatcccagctattcgggaagctgagacaggagaattgcttgaacctgtgaggcggaggttggggtgagctgagatcgcaccactgcactccagcctgggcaacaagagcgaaactctgtctcaaaaaaaaaaaaaaaaaaaatgtatcgttatagccggaagcagtggctcacgcctataatcccagcattttgggatgccgaggtgggtggatcacttgaggtcaggagtttgagaccagcctggccaacatagtgaaacccagtctctactggaacatataaaaattagccaggcatggtggcacacgcctgcagtcccagcttctcaggaggctgaggtgggagaattgcttggacccaggaggtggaggttgcaatgagccaagattgtgccactgtactccagcctgggcaacagagtgagattccatctaaaaaaataaataaataaggaccgggcttggtggctcactcctgtaatcccagcactttgggaggctgaggcaggcggatcacaaggtcaggagatcaagatcatcctggctaacacagtgaaaccccatctttaccaaaaatacaaaagattagctgggcatagtggcacatggctgtagtcccagctacttgggaggctgaggccggagaattacttgaaactgggaggcaggctgcagtgagccaagatcacgccactgcactccagcctgggtgacagagcaagactccatctcaaaaaaaaataaataaaaacaaaaataaaaactaaattacaaaataaaataaagttattataaaggtgtctactagaaaaaatatactaatttttctaaatatactaatatactaatctttctaaatatactaatctttctaaatatcagaagaactacatataaaaaacaaagcaaaagcaaatagacaaattttaaaaaaatggaaaacaatataacagatctaagactaaacataccttagtcacatctatgaatacaaatggggttagcatcccaactaagagaaaaatatttttaagttaaatcataaggcaaaacataattctctctacctgaaacacaactagaacagaatattgaaaatgaaaagatgagtaaagctgtattaagggagagtgcaccagaagaaagcaaaggtcatggtttttttcttttttttggcggagtttcgctcttgttgcccaggctggaatgcaatggcgcgatctcggctcaccacaacctctgcctcccaagttcaagtgattctcctgtctcaggttcccaagtagctgggattagaggcatgcaccaccacaccggctaattttgtctttttagtacagacggggtttctccatgttggtcaggctggtctcaaactcccgacctcaggtaatgcacgcaccttggcctactaaagtggtgggattacaagcatgagccactgtgaccggccaggtcatggctttaatttaattttaggtaaattggagttcaggccaaaaaaaaaaaaagattaagtaagaccaataaaaacaccttgtaatgctaaagggtatgattcacagtgaagatataatgatataatagttataaataactgagtaccaaataacaatgcaatggcactcataaacttggaattacaggatacaaaaggagaaagaaacagaatcacgctggtttcattcctgactctatagtctatgacaaatcaaattaataaaaatgaaatcaataatatagaactctcatataatctatgttaaacatgatcgttcatatatatatatacatattctctacacatagagcatattcttatttcaagaatattcaagaatagaacattcaggaaaactgaccacatatgaggccacgaaaaaaacctcaatacattccagaacatagaaacagcataggcagccttctttggtcacaatgcaataaaatgataaattaatttttaaaaacagataacaaaaattccttttcacctgaacatctttaaagtttatcctatatgaatttaaagaaattcttcttaactcttggatcaaaatataatattaacctaaatcacaggacttctagaaaataaaaataacaaaaacaatacattttccacaccttggaatctatgagatagtgttaaggtagtagtggaagataaattcataggtttaaatacttaaataaataataaataaaaaccaaatgaaccaagcatctagcttagaaaaagaacaataaaataaactgaagggatgtagaaagaatgaattaataaaaataaaaacagaactttctaacttagtgaattagaaaacagaaaaaaaagaagtaaactgaatctttggggaaaagaattaaagaatagaaaagcactagctaacttaatacagaaaaaaaaagtagaaaatgcaaatgtacaaaataagaaagactaagagaaaaccacgaaactatattaaattaaaacaaccataaggaaatactttggtcaactccatgaaagtaaaatttgaaaacttggatgaaaaatacaattttcttggaaaatataatttagcaaaatggatcccaaagaaaaaaaatcaaagcattctgattctcatacaacaaagagaaaaagttgccaaagagttccctcagaaatgcccaactagtgtcacaggggcattctaagatatctttaaagagcaggtagtactcaattctgtgtaaattgttctagcatgtagaaaagaaggaacatgcttgaattattttatgaaatataacattgatttcagaacctgagatggcacacttcaaccaagaaaactacaaatgcatctcatgtattaatgcaaaaatcataagaaacaaataactttcaaaaaattacatgggaataatgtggggacaattttgtgaccactgtttagaaaatgcaatctgacacaacttcgagtatggaccagttgcctcaggtgaaccctgggtgctggacctggaatcagccaatggccgtgttcctctcccagatagctgcccaacaccacacccttaatgcacattccttcgtgggttcattcttcagcaggcagcacaaggccattcactgctcctactgcctctttttatatagtatcagaaagttccagagagactgggcacagtggctcacgcctgtaatcccagcactctgggaggccgaggcaggtggatcacccgaggtcaggagttcaagaccaacctggtcaacatggtgaaacaccatctctactaaaaatacaaaaattagctgggcatggtggtgcatacctataatcctagctactcgggaggctgaggcaggagaatcacttgaacccaggaggcagaggttgcacactgagccgtgatcgcaccactgcactctagcctgggtgacagaggaagactccgtctcaaaaaaaaaaaaaaaaaagaaagaaactaccagagagttccagaaccttccttcaaaactgggagattcctggcccttattcaagaggtcccccctatgactagctgcctcctcagataaacaacatttccagtgatctttaatggatgattatggggttctgtgatgcccttcggtgtaacacatttgtgtattttttgtttgttttgcagagatggggtcttgctatgtggactaggctggtctcaaactcctgggctcaagagattctcctgccttgggctcccaaagtgctgagattataggcatgagccaccacacccagcccatatttgtgttttaattgtggacttccttcacttttagctcctttaaataaaagattcaggcattagaggtattgtgtcctgttaagaggaaggacattggggtggggggcctagtaagcatttggcgtctcccatattacacagtgtaagtgacttttgatggcttcaataggcagcctagcctattagtactgcagctggggacccacatggtatctggtatttctaccacaagttagctgaggtatttgtaaaatcagcatattcttaggtgcatgttgtctaaatcatgactgccaagctcccaggaggaactcgactatcctgtatttccaggatttctccctttttcggctgcacccggttgagcacttgcttgtaagcccaggtttccatgcctagaactaatggttaccccaaggccctctctttgccctgcaactggatggaatgtatcccatgaactctaaagggaacccagcagacagaacatagcagtcactacctttagaagaagcatcctcaattagttctctttcaggctggagttactcccgggctgggagtatccagcttcagggaagggctgtcaaccctgacccctgacccctcaggcacggggttggcttctgcagacattcccagggcacccccttctgccaagcttgggtgtggacaagtgtaattaatcgggtcctcaccaccaaagcttgttcagatttgtcagttggttgttttttaaattattctgtttgtcattcttctcactgaggcagcgggctgtttatcctacaacacacaggcaaaggtgaatcgtgttaaatgcagggaggaattaggggagaaggatttggtttgatggggaattttcagaggaaacgaaaatcaagtttatagataaaaacaaggtaggaagcaaaggattgggagattttcagcctgtattacaaagaatcgactcttgcttcttcctagatgctgagtctacatggattagaagagagacgctcacttcatccaggacacaaagagagcaagcttgcagagcacttgcccaggcctgcatccgccttccctgccttccctcggatggggctgggtgattgcagcggccttcaccacattgggtagaagcagggagacatgcaaattagaaaaccaggagatcgtcacagcagatcagttttcaaaatctgggctggacataaactggagtacttctaatctgatcaggacacctggggctgtggcaggaagcaaattctatttttcaaaagacaggagaattgctctgagtatcgtgatggctcgcatcatcttttccaccaaaattccaagacgccttagcgttgctggatatgtattgtaagccctacagccttcatctcatccagacactcgagataaagaaatgttagccggagtttaaaccataagaacagatatgactgaaatggacctcatttcaccggagattcccaagtcagattcacaaacacatggggcgtcctggtggataaacctttccccggaagacacatttgtgaagagtcttggcccccagtgttgagactgattcggcgtcctgaaataacaacccgctgccgaggcactccactcggaagggcgtgagagcctgacctctgaggctgaaattacagaccaccctgtcaggatgcacggagcatgtcgaagaggacgaggctggtgcccgacagttgacgcagcccgcctgttggccacagggagccactgaaggcagatctcacgtcacgatcagtggcctctgcacgtctctgtgaggctggggaaatgtcagggactgagggactcccacttcatctgcaaggggaacagggaaaggccatcagtaccttcacaagaacagaaaagcttccaaagcaaactggagcatgtcacttggtgcgacgcacatgccgcacggccagccaccgccactccccaatttctcctttgctgggaaagccctagttttgtcatggtgtccacacatctcctctaaggctcagaggcaaacctcagcattttcagccagttctaatggctccattcccccaggcagtgatttatctagggacgtggttgtgcccatttctggccatatgcaaaataagagggaatggggagggagttctaagaaatgttttctggtttataaagagttaggaggctgggcatggtggctcacgcctgtaatcccagcacttttggaggccgaggcgggcagatcacgaggcaagagatccagaccatcccggccaacatggtgaaaccccgtctctactaaaaatacaaaaattagctgggcgtggtggtgcgcgcctgtagtcccagctactcgggaggctgaggcaggggaatcgcctgaacctgggaggcggaggttgcagtgggccacgatagtgccattgcactccagcctggacaacaagagcgaaactctgtctcaaaaaaaaaaaaaaagaaagaaagaaagaaaaagaaatattaagcgattccacattgaattcctaatacaaaataaaagagaaaaaaatactaggcaatatgagagtaaaaagcaacaaccatttgtattacatatattatttatcttatggaaatggtcctgcaagttagatattaatttctttggtttctatctgaacaaactcaagttcaaagcaattaagcaatgctcccaatctcacccagcctaagctcatctctttccactgtaggctcgtgcagatatttaggtggagaggaaactgcaccacaagtaagacctaaaacaggcttatcatttgttttccttctggcaacaggaaaaagaaaatctgtccagatttccaaatctgtcctctgaatgggtctgtgcaaacatcaggacctaaaatagatcttccaataaatagcacaaagtaggggggacaggaggaagaagtacaccggccatataaaataatactgtcctctgttccaggagcattacatatatcatgtcatctccatcaaagcaggcattatgatgttcattttctaaataaggaaatgagaaagttaattcatttccctaaggtcacagagctctgagtaactgaactggattggaagccctctctgtgtgaggccaaggcctgagctgcttttcccttaattgcagggtacatgtgtgagtgtgcatacatatgcacatgtgtgagtgtgcatacatatgcacgtgtgtgtgtgtgcacttgtgtgcatatgcgtgtacggttccaattttatgagtttgtaaactttctgtatcaagtagaatatacccatctgtcagagtaagacaggagtaaaaattgaattaaatgaaaagtaggactgctaagcaggagaccaaattctcagcaccaaatctcaggcccaacacaggcacctcccacctaccactgcccactctggggcagcccagaaaccctgagttcatcaggacagaccctgggagacagagcacagaactgtaacctgggctggcggaaacaactcctcctctgccgatcccccagcaaggagccggctgccctcacccccacttgcattagctaactttttcaaaaatgaatcagagtttcagatgaagctccataaaaccgtgggctgctctgagactgcaaattgctagcagatgtctttttggttcgagtacagtcacattcctgccaagcataaaaatgagaggttagagaacagatcattttattatcacataaggaaaaccagccaattaagccttcatgtttttcaggtatatgtggcatggattttgaaatctccttgcaaaaggaccatatctttgatagctaaaaaaggccttggctcttcaaggtgaagtcctttgcatctgaattttattcatttgaaaacacaaaatagggtgtgtatttctttctttcttttttttgagacaaagtctcgctctgtcgcccaggctggagtgcagtggctcgatctcggctcactgcagcatccacctcctgagttcaagcggttctcctgcctcagcttccctagtagctgggactacaggcatctgccaccgtgcccggctaattattttcagtagagacagggtctcaccatgttggccaggctgatcgtgaactcccaacctcaggtcatctgcccctaccttggcctcccaaagtgctgggattacaggggtgagccaccactcccagccaagggtgtgtgtttctacatttattacctatcagggcagagtgattttcttttaagctttatttaaacatgctacaggccactctaacatactttattattaaaatttcatcagagcctgaaccattttcttatttgttcttgttctataatcatatgtaacaaattataggatttcagctgaaaggtgatgtgtgtgtatatatgtatatgctataatttttctttttgtgggtggtgggtggggctttatggtgcatatttttacttatcaagcttagagtgtgtttgtcacaaaatttccattttaagagtacttactagtctgattaaacacttgtaaaaatgtcaatggtcaataaccttttaaatgaatcagctgagcttgactaggatgagcttaatttagcaattagcctggccaaattgtctgttattatacaagaaaagtttataataaagtacatgcctcagtataataacttttgccaggcacagtaaatcaaaaaccatacgtctgctgagtcagctccaactgcagggacggcagctaaaaatgtctctgacttacaatgaaatttgtatcctcaatgtttaacattaaacctaaagacaaggccaggtgccgtggctcacacctgtaatcccagcattttgggaggctgaggccgggggatcacgaggtcaggagatcgagaccatcctggctaacacggtgaaacccccgtctctactaaaaatacaaaaaataagccagaagtggtggcgggcgcccatagtcccagctactcgggcggcaaaggcaggagaatggtgtgaacctgggaggcagagctttcagtgagccgagatcgtgccactgcactccagcctgggctacacagcgagactccatctcaaaaaaaaaaaaaaaaaaaaaacctaaagacaaacactgcaagttcaagaataccagcagagttatattttctcagtgcagttcaaatccatgaatctgctagcttctttgtggtaggagactatgaagctcatagggggaaaaaactggccatatttctgaatagtgaattcagctagaaaccagcaggcctataacacttgtttttgtttggctacacatggccctgagccacaaaacattgcagagcagcccgggagctgctacaaatgaactctgctgcccaccccctggcaaccccatgacattttcatcctgaggctgtaagtgttttgatgcttctctggtcttgatcatacaacccttcatcactcagagctgaatctcttagatgaaatggttttcattttgtttttctttttgttttgagacgaagttttgcttgtcgcccaggctggagtgcagtagtgccatctcggctcactgcaatctctgcctcctgggttcaagcaattctcctgcctaagcctccctagtagctgggattacaggtgcctgccaccacgcccagctaatttttgtatttttagtagagacaggatttcaccatgttggccaggctggtcttgaactcctgacctcaagtgatccaatcgcctcagcctcccaaattgctgggattataggtgtgagccaccattcccagccgatgaagtggttttctggtccttttttttgagactgactttcactctgtcgcccaggctggagtgcagtggtgcaatcttggctcattgcaacctttgtctcctgggttcaagcaattatcctgcctcagcctcccaggtagctgggattacaggtgtgcggcaccacacctggctaatttttgtgtttttcgtagagacggggtttcaccatgttggtgaggctggtctcgaactcctgacctcaggtgatctgcccacctcagcctcccaaatgctgggattacaggcgtgggccaccgtacctggctggttttctagacctttaagccagttgcagcacagcccactctccaaatttacaaagcacactcctcccacccccgcccacccgccccccccccccacccgccccccccccccgtcagatggatgcatttacccttagctctgccaccaagacctaagcagagagcagggagcctataatcaatcaaccaatcagtcaatcagtcaatctgtgtttacggagcgtctgccaagtgtccagcccttgctctctaaataccatctctggagatataaaatgagtgagcagaatggaagtccaaagcatcactatgaaacagaaaacagtatctgctgactttccatcaacagcctaactcaaaaatagcacaaggccgggcacagtgcctcacacctgtaatcccagcactttgggacccgaggcaggatgatcccttgagcccaggagttcgagaccagcctgggcaacatggtgagaccccgtctctacaagaaacttaaaaattagccaggcgtggtggtgcatgttggtattcccagctacccgggaggctgaggtgggaggtttacttgagtcggggaggttgaggtggcattgagccaagattacgccactgcactccagcctgagtgacagagcaagaccatgtctcaacaaacaaataaaaaaacaaaaatagtacaaaatagtgagtgcagtatgaggaggacattctgggaaagttaagatgttcagaggtgaatgtgagtggacagtgtggtgatgcaagcagccccatcctggaattagtgggatgaggcatctggcatctgctgtgggaactctccctctgcagaaaggactgcctggccttgcccttcctggcctctccagctctcccatcaccaccagagccccaaatcccccactccaggcctgccccagccagaagggacttggtgagctctgccccatgccacaaagtggtaggatccacataatgtctgaatgtgaaccatggcaaagaggcatgaaaaatacaagatcctaggaaagggaatggttgagaaggctaccttgatgcttccgcttcaaaagtttctgtccggccggacaaggtggttcacgcctgtaatcccagcccttgggaggctgaggtgggcagatcacctgaggtcaggagtccgagatcagcctggcccacatggtgaaaccctgtctctactaaaaatacaaaaaattagctgggcatggtggcaggtgcctgtaatccaggctacttgggaggctgaggcaggagaattgcttgaacccaggagggggaggttgcagtgagctgagatcacgccattgcactccagcctgggcaacaagagtgaaaccctgtctcaaaaacaaaaaaaaaaagtttatttccagctctttgaaataacacacagctctattttattgttgagttgtaagagttctttatatattcaggatacaagccccttattggatatgtgatttgtagacattttctctgattctgtgggttgtgtgggttgttatttcccaagggaggctgtttggttgacatttaattaactccttagacagaatcctaggggtagtgttagacattgtcatcgtcagccatagtctggaagtctagaatgtcggcttctcattagtgcatctttgtccctgacagccgaccacctgcctcatgtgagggattggcttgtggaatgatttggaaaagagaaagaacaactcatttctcttgttaattaaaaattatcatccgtagcttcatcttaatgcattttcaaattagcctccatatggccaaattactctagcatgataaagaaactcacatggttggccaagcgtgatgactgatgcctgtagtcccagcactttgggaggctgaggagagaggattgcttgagcctaggagtttgagaccagcttgtgcaacatagtaagatccggtctctacaaaaaattttaaaattagacaggcatggaggctgaggcaggaggttcatgtgagctcccaagttctaggctgtggggagctatgattgtaccagtacactccagccagggtgacagagcaaagccctgttttgggaaggaaaggaaacgaagggaaggggagggaaggggaggggaagggaggggaggggagggaagccgggcacgggggctcatgcctgtgatcccaccacttggggaggatgaggcgagcagatcacgaggtcaggagttcgagaccagcctggccaacatggtgaaacctcttctctactaaaaatacaaaaaaattagccgggcatggtgccacatgcctgtaatcccagctcctcaggaggctgaggcaggagaatctcttgaacccaggaggcagaggttgcagtgagatgagatcatgccactgcactccagcctgggcaacagagcaagactccatctaaaaataaataaataaatgaaagaaagaaagaaggaaagaaagaaagagaaagaaagagaggaggagaggggagggagagggaaagagagcaaaggaaggaaggaaggaaggaaggaaggaaggaaggaaggaaggatggatggagaaagaaagaaaagcaaagaaagaaaaaagaaatgcaggccaggtgtggtggctaatgcctgtaattccagcactttgggaggcagaggtgggcaggtcacttaaggtcaggagttccagaccagcctggccaacatggtgaaaccccatctctactaaaaatacaaaaagtaactgggcatggtggcacacacctgtaatcccagctactcaggaggctgaggcaggagaatcacttgaacctgggaggcagaggttgcagtgagctgagatcgtgccactacattccagtctgggcaacagagtgagaacccatcttgaaaaaaaaaaaaaaagagagagagagagagagagagataaatgcacatagaaaatgttagctggccacctaagccgattttattgatcattttgagtagatgatcatgtagttcacatggtaaccatttcctcaagcatctcataagttgaaccaaaaagcaatacattatctacagaaatagtactaacattttcaggaaagtcacctactaatgatctaatgatgtctgcttgcctccttatgccaggctgaaaacttgttttacttttcctgataaaaaatatgcaggaaaagtcttcatttcctgaaggtcttctcgccagtctgccatgaacactctgagatgcaaacgactctgtgcccagaagaagcaaatctcacaactagtggttccctggccagtcacattctctttttctttctttctttcttttttttttttttgagacagagtctcgctgttgcccaggctggagtgcaatggtgcgatctcggctcactgcaacctccacctcctgggttcaagtgattctcctgcttcagcctcctgagtagctgggattacaggtgcgcaccaccacatccggctaattttttgtatttagtagagatggggtttcaccatgttggccaggctgctcttgaactcctggacctcaagtgatccgcccaccttggcctcccaaagtgctgggattacaggcatgagccacagtgcctggcctacattcttttttctaattgccaaaaacaattgtatgtacttatggacaaacaacaattgtatgtacttatggtgtacaagatgatgtttgcatatatgaacacatggtggaatgactaaagctaattaacatatcaatttcctcacatacttatctttttatggtgagaacatttaaaatctactctattagctatttcaaatatataatacattgtcattaactataataattagtgctttttgaaaaagacaaaagattatgagtcgtttctacacattctttttttttttttttttagagagtgagtctcactgtgtcgcccaggctggagtgcagtggcacaatctcggctcactgcaacctctgcctcctgggtttaagcgattctcctgcctcagcctcctgagtagctgggattataggcatgcaccaccatgcctggctaatttttttgtattttcagtagaggtggggtttccccatgttggtcaggatggtctcgaactcctgaccttgtgatccacccatctcggcctcccaaagtgctgggattacaggggtgagcaactgcgcccagccctacacattcttttccattctaaaaactagttattcatggaaacaggatacaactgattcttaggaacacgaattacatcagcatggaaaagtgtctagtaagatgtgggtaatgatggaagccaaagtggaagctcaagtaatctccatctgaagcaactgtaaaaccagaaaggaagccctcagaattttgggggtgctccatgcaaaaagcaaagataggtcttagatggtgaatttatttctatattaacatttgatcacctcacaaggagagaagatgtggaagaagtaccttttaaagaaattcagaagatatgaagtgagttatcccctactccaactgaatgccaggattcctacacacagtgaaagagcttttactcagcaggcttattatgtaatatgtgttcagagttcagattcttaagggcagaacgtaacaacttcagcctataaaggtaggtcagaaattgctttttttttttttttttttagagacagggtctcactttgtcacccaggctggagtgcaatggtgtgatcttggctcactgcaccctcgacctcctgggctcaagtgatcctcccacctcagcttccttcaagctgggcctacaggcactagccaccatgcctggctagtttttaattttttgtagagacagggtctcaccatgttacctaggctggtcttgaactcctggcctaaagcaattctcatgccttggcttcccaaaatgttgggattacaggagtgagtcaccatacctggccagaagttgcatttgatggcagagagagatactacctggaaatcatcatatccacacaacaagtagcatctttaatttaaatgtaaatgtgatttctttgcagcttggttcaattccattcaggccctgaaactgttagtcaaaatcaacttgttgagcagagttacatgttctgagtttcaatactgcaatgtaagaaagaaaacaaggacagattgatgatttcaggacagcatctgagtttactcattccacattagagctgtgtgaagattgcctcggagtggcacagtgttgatgtttctgcctgtgtttaatttcttgatttcacgaacagcttggattttttttaaagtgcttctgactcattcacatgtggttgcctgacataagcccacacaccatttgctcacaaatatgtcaatgactgaatccaccaagagcctcgacctgagaaacctgggcctagattactgagaggatctgtggctgcttgtatatagtctttctccccatcagctccatgattcagtatcatagttaatatggaattctcccttgttaacatgaaaatcgctttggcaaagtgttatgtttgtatgcagagcttggagttaatgtcaggaatttcattttcttttttttttatttttatttatttatttatttatttatttttagagagatggggtcttgttatgttggccaggcttgtcttgaactctggacctcaaacaatcctcctacctcagcctccccaagtgctgagacgacaaccgtgagccaccgcacctggccttctttttcttctaaatgctgaagttagattctacagggacctaaagggagtgttagtccaaagtcttctttgcccctcaaagatactctttaaaaatccagttcttatcctcgtaactcataaataccagacagacgcaaggtgcaggaagtcatgccctctgcatcagtggattcacatccatggattcagccaacgaccaatcaaaaatattagggaaaggactgggtgcggtggctcacacctgtaatcctaacactttggaaggccaaagtaggcggatcacctgaggtcaggatttcaagaccagcttggtcaacatggtaaacccccatctctactaaaaatacaaaaattagccaggcatggtggcgcatgcctgtagtcccagctactcgagaagctaaggcaggacaatcacttgaacctgggaggaggaggttgcagtgagctgagactgcgccactgctaaggcaggagggtcacttgagctcaggagtttgaaaaatattggggaaaaaaattgcatctgtactaaacatgtataggcttttctttccttgtcgttattccctaacaagacaatattcacacgtcatttatattaagcttttttgtttgtttgttttttgtttttgtggttttttgcttttagagacagggtcttactctgttgcccaggctggagtgcagtggcaccaccatagttcactgcagccttgaactggactcaaaagatcctcccttttcagcctcccaagtagctgggagggactacaggtgcacgccgccaaacccagctcattaaaaaaaaaaaaaatttgtagagataggatcttgctatgttgcccaagctggtcttgaactcctggcctcaagtgatcctcctgccttggcccccaaagcactgagattaccacacttggcctcaaacagccctccttgtccctgttagtctagtaacctcgtctaataactgtacctcgtgtttattgactctcagggaattgcatcctctttggagacgatctcatgtctatgacttgagttaagcatcagagatgttctcttttcacggagctaatagtccattactggcaactgacattaaaaacatgacccacacccacctctggggaagagctgccctggcacttggcagcctcccgggaaaggtagttggggtgagggtgtcacccccagaaggaggtggtgaaatgaagcatccacatcatacagtggcgaccagaggaggagagcttcctatattcccggaccccagccgtgcctcaatgagcagagttcttactggagccgcagaagcgtattaacctcgcgaccccatgacttgcacagaagcgggttctttctccacactccctgcctccgtgggcgaccgccttcatccttaatatccaacgtgacatgaaatatctacaatagcaaccaaatcactgacaccagatgcgatgtcaaatgctctgcattacccaaacagctgaatcggggccgccatccgcacttccagcttcagccctggaaaaccaccctgtagggtgcactggggctgcggctgcagctgttacctggcagcttagctcagggagccctctcctctgcccttccgggctggccaggttaggggctctctgagacagtgacccccggaggctccttttcagctgctgtcctttgtgtagcatcagttgctctccagggttcaccacctcctgagaggacttcacagctgctccgggaaagaaccactccctccttgccctttcttctcatttcattttcctgagaagtcagagccattcaccgctcactgcataatcagttttatcaagatactaatgaatttaagaggcttatttgtccccttggatgtcgctaaatgcccactgctcagaaatacagctgtgtcatcctccctcaatttccatccgcactgaagctatgacggagcaggagctttgttttgcttggggcagctgccactctgtgacacacatcaaagggtgtgcgcttccacccgcatctcccaggcgcgcagtaagtggcatttcagggagtttgatggaaccatctgagtaagtacttgtgtttaatgagattcattcttcatgtgttcccactagccgcaagacggttttgcatttaccggaattgtaacaccataacactccattttaatgacggccggtggcagctggcaccccagttcacagcaccaactttttgttaatgatatgcaattggaatatatttatcccctattgagagatgggagcacagcagccaattggcttgtgcttgtctgacttaagcataaggatcagagtaacaaggacccagttttcatgacctgttatcttttgctacgtcccaggtcccgagagccttgaagactcataaatccccactgaagatcatgagcctgagcatctgagaagcagccaggactttgttcctaattatttgcaaaaacaggctccttaggcttgcatcagaagtcctttggaataaaatcagacctcaggaggatgcctacaggtaggaagaacatgaagaaatttcattcatttatttattcactcaataaacaaattcaaacaataaacaataaagaagcaggctggggccagacatggtggttcacacctgtaatcccagcacttggggaggctgagggggggtggatcacctgaggtcaagagttcaagaccagtctggccatcatggtgaaacaccatctctactaaaactacaaaaatttagcctggcatggtgaaacatacctgtaatctcagctacttgggaggctgaggcagaagactccctggaacccaggacatggaggttgcagtgagccgagatcacaccactgcactccagcctgagtgacagagcgagactctgtctcaaataaatacataaagaaagaaagaaagaaaacaaagaagcaaatatgtagaacatcagaagaagaatcatgaaaagaagtaaattttggttaaataaagaatgttggagtctcaaattgatcaagaggatgtttttgttaccttaggagggttcaactggattgcaatgataagagagctgaaattgaaaacattttaaaatgagcaagccaactctaaaagatctccaaggcaaagaaaccctgaccttcccacagtgatttcagctcatttttagacccatttagtgtctaagatttagaggcacagaagatcagaatctgcctgtcctgacatagcatccaatcctgagaacaatgaaatagtcaccctcatttgacattttttttttcttcttataaaaattatataaactctggccaggcgcggtggctcacacctgtaatcccagcactttgggaggccgaggtggacggatcacctgaggtcaggagttcaagaccagcctggccaacatggtgaaacttcgtctctactaaaaatataaaaattagtcgggtgtggtggcgggcacctgtagtcccagctactcgggaggctgaggttggagaatcgcttgaacccaggaggtggaggttgcagtgagccaaggtcatgccactgcactccagcctgggcaacaagaggaaaactctgtctcaaaaaaaaaaagaaaaaaagaaatatatatatacatatacatattcattataaagactgcagtcattatctatagaaaatgaaaaggaaaagaaagaaaaagaattgaaaacaaaaagtgaaaagggaaagaaaaagaaaaataaataaaaagtgaaagaaaaagaaaaaaatcgtccataataccatcaccaaaaatagcttccatcaaatattggttagagacatacatgtgtttgcatgtgtttacatgtgtttgcatgtgtttatatttttcccacaaaagggtgagcatacagtatatctcagtctgtttgtcttgctacaaaggaaaatcagactgggtaatttataaagaagagagatttatttggctggcagttctgcaggttgtacaagaagcatggttccagcatctgcttctagggaggcctcaggaagcttccacacattggggaaggtgaggaggagccagtgtgtgcggagatcacatggcaagagagagcgcaagggaaagagaggggaggcaccaggctcttcttaacagccaactcttgagggaattaagagtgagaactcactcaaaccccccaccccagggaagggattaatctatccatgagggtcccactcacatgacccaaacacttccattagacccacccacaacactgggatcaaatttccacatgaggtttgagggagggacaaacatccaaactgacaccctccattttgttctatatcttctgtttacgtttactttctctcccatgccacttaacatctgcacagtcatttagaattgtgggatcattgcctagttttccatggaatagatgtagcataaataactttacctaactcctgaaagaaaaagaatgtcagggtgagggtagagtttgttattctgtgttgcttggtcagaatgcctgactgaaaggctgggtttggtggcttgcgcctgtaatcccagcactttgggaggctgaggcaggtggattacttgaggccaggagttcaagaccagcctggccaatatggtgaaaccccatctctaccaaaaatacaaaaatcagctgggagtggtgacaggtgcctataatcccagctactcaaggggctgaggcatgagaattgcttgaacctgggaggcagaggttgcagtgagccaagattatgccactgcactccagcctgggtgacagagcaagactccatctcgaaaaaaaaaaaaagagatcaggagcaatggctcaagcctgtaatcccagcactttgggaggccgaggcggatggatcacgaggtcagcagtttgagaccagcctgaccaacatggagaaaccccgtctctactgaaaatacaaaattatctgggcatggtggcacatgcctgtaatcccagctactcgggaggctgaggcaggagaatcacttgaacctgggaggtggaggttgcagtgagctgagatcacgccattgcactccagcctgggcaagaagaatgaaactccgtcaaaaaaaaaaaaagaaagaaagaaaggaaggagggaaggaaggaaggaaggaaggaaggaaggaaggaaggaaggaaggcaggcaggcaggcaggcaggcaggcaggcaagcctaactgacaacaggacactgaggatcaccctgaaggaggaggagtggatagcgagtcatgctgctctctggaggaagcctgtttggggtgggaggacaatgccaagggccctaaggcaggactatgcttggaatgtccaagaaagagcaaagaggccacaggcgaggaggtgagactataggagacaagttcagagagggagtagaggccgagtgatacaagactgtgaccagcgtcaggttgtgggctactgctgggtggaggagaagccaacagttttacacagaagacagacatgcccgattacatcttaatgggctccccagcttctgtgttaccatagactaccgtgggcaagggcaggacagagagacccgtcaggagctgtactagtctgcaagggctgccataacaagatactgcggcctgggcagcttcagcaacagacatttgtgttcttacagttctgagactagaagtctcagatcaaggtgtcagctggtttggtttcaccaagggcctctctccttggcttgtgcacagccacctttgtgctgtgtcctcacatggcctgtcctctgtctgtgcacccctgtgtctcttcctcttctaagaacaacagtcgtattggatcacggctccaccattatcatctcctttcacttctttaaaggcactatctccaaatatagtcatgccagggattagggcttctgcatatgaattttgggaggacataattcagttcataacaggaagtgactgcactaaccccaacaagagaggactgtgcttggaccctggtcttaccagtggagatggtgagaaggagctgggtttcagctctttttctgaaggctgaatgagacagaaccatttttgtcccagcattcgtgagtatcaagaatgagtggaaggaagacattaaattgtgaatgctagaaaaaagagtagtgaaagggtcagggggctggaaggaattttcttttagctcctctgttttttagcctcttaaaacaagcctgtagtgcagtctaactgaaagaaagtagaaatatgaaggcatttttattttaatataaaaatttatttaaaagcctttagctcttgaaatttaaaagtacaattaaaaaataaagaaaggcattttgttagctttttattgaaatataataaactttcagtaacatgcacgtatcttaagtatacagctcaatgagattttacatatgtacacactcatgtaaccacctctcatgtcaagatatagaacatttccagttatctggaagcttcactcattgccctctcccaatcaagagctccccagaggtaaccactatcttgattctaacaatatgaattggttttacctattcttgtactttgtataaatggaatcaagtgatgtgtatttttgtgtgtgcatcttactcttttcactcaacattatgcatatgaagtttatccatgctgtttcatgcagctaaagttcattcactttatgggtgggttagtattccgttgtataaatagaccacaatttacttatctcttttatttcagatgaagagttgagttgcgttcaccttttaaccattataatgtaagtacagtttcaataaaaatatctatgtatgtccttttgttaggcatatgaactcattaggaaaagcatttcttctcatcaagtaagaaatagttccctttctcaattaaaaagtagtcccttttctggctgggtgcagtggctcacacctgtaatcccaacactttgggaggccaaggcgagtggatcacatgaggtcgggagatcaagaccagcctggtcaacatggtgaaaccctgtcttaattaaaaaaaaaaaaattaaaaaagtagtctctttccttctctctgtccagaatcttgttaacaacaaaaatgaacactttaggactcctcaagcatgatcactttcaggatggtgctggagctagttcatccaagctcaggagagcccattgttaagttttcaggaatcttgcaaactgaatgctaaccacagactttattaaaagtagatttatatgcatttcaattaatttcaaaaaaattgaagaggaaagaatacttccaaattcattatatgaagccagcgctatcttgatatggaagtcagacagacactacaagaaaagaaaactacagaccaatattcttggtgaatattgacatagagattctcaagaaaatactagcaaatagagttcaatagaacaactaaaatattatacatgatgactaagtaagatttattcctggaatgcaaggatagttcaacatatgaaaatcaaacaatgtgatatatgacattaaagatgtatgacactagaagaaaactatgaccggacgtggtggctcacacctgtaatcccaacactttgggaagctgaggcaggtgaatcacttgagtgcaggagtttgagtccagcctgggcgacatagcgagaccctgtcaaaaaaaaaaaaaagaaaagaaaagaaaactgcctcaacataataaaggccatatatgagaagcacacacaactaacatcatgttcaatgctaaaagactgagaactttttccccaagatcagaaacaaggcaaggatgcccactttcaccacttttatttaacatagcactgaaagtcctagccagatcaattaggcaagacaaaaaaaaaatgcatcaaattgcaaaggaagaaataaaatgatttatgttcccagacaacatgatcttttaggtagaaaaccacaaatattccaccaaaaacatctgttagaactaataaacagatccaacaaagctgcaggatacaatctcaacatgcaaaaatcagttgcacttttatatactaacaatgaataatccaaaaggaaattaagaaaataattccattaacagtaacatcaaaaaatatatatattgaggaataacttagccaaggaggtaaaaaatgacacactgaaaactactgccagttacagtggctaatgcctgtaatcccagcactttgggacgctgaggcaggtggattgcttgagcccagaagtttgaaaccagctgggcaatttggcaagactctgtctctacaaaaataaaaattaaaaaaagtagccagacatggtggtttgcgcctgtagtcccagctactcaggaggctgaggtgggaggatcacttgagcctatgaagtcgaggctacagtgagccatgattacaccactgcactccagctgcctgggcaacagagcaaaacccagtctcaaaaacgaaaagaaaagaaaactacaaaacattgccaaaagaaattaaagaagacacaaataaatggaaagatatactgtgtttgtgggttaaaagacttaatattgctaagacgttgatattggccaaagcagtctatagatttaatacaattcctatcaaatctcaagggcattttttgcagaaatagaaaaacctattctaaaattcagacaccagggttcctgaatagctaaagcaatcttgaaaaagaacaacgttgaggccaggcgcagtagctcacgcctgtaattgcagtggctcatgcctgtaattgcagcactttgggaggccaaggtgggtggatcacctgaggtcacaagtatgagaccagcctgcccaacatggtgaaagcccgtctctactaaaaatacaaagattagcagggtgtggtggtgcatgcctgtaatcccagctactcgggaggctgaggcaggagaattgcttgaacccaggaggcggaggttgcagtgagccgagattgtgccaccgcactccagcctggatgacagagcaagactccatcaaaaaaaaaaaagagagagagaaataaataaataaataaataaataaatctcgtctctaccaaaaatgaaaaaaataaaataaaaataaaaataaaaaaagtagccaggtgtgatggtgggtgcctgtaatcccagctacttgggaggctgaggcaagagaatcacttgaacctgaaaggcggaggttgcagtgagccgagattgcaccactgcactccagcctgagtgacagagtgagacctggtaaaaaaaaaaaaaaaaaaaaaaaaaaaaaaaaaaaagaacgaagttggaagtctcacacttcctaactctaaaaaatttattacaaacccacagtgatcaaaacagtatagtccagcctgggcaacatggcaaaaccctatctacaaaagatacaaaaattagccaggcatggtggtgcacacctgtagtctcagctactcaggaggctgaggaaggatcatgtgagcccaggaggttgaggctgcggtgagccaagattgtgtcactgtattccagcctgggcaacagagtgaaatgttgtttcaaaaaacaaaaacaaactgtgtagtattggcatacagacagacatatagactaatggaagggaatagagagcccagaagtgctcattttggcagcacacatactaaaattggaaagatacagagaagattaacatggcctctgtgcaaggatgacaagcaaaaatcaaaaattattttaaaaaattaaaagaatacagggtccagaaataaaccctcatacgtatagtccaatagtttttaaattagggtcccaagactagtcagtggagaaagaagtattttcaacaaatgatttcaggaaaactggatatctgcacgcaaatgaatgaaactggacccttacgctatatgcaaaatttaactctaaatgaatccaagacctaaatgtaagacctaaaatgataaaactcttttttttctttttctttcttaccttttttttttttttagagatggggtctcactgtgttgcccaggctggtcttaaattcctgggatcaggccatcctctcgcctcagcctcccagagtgctgggattacaactgtgaaccactgtacctggcctatacaactcttaaaagaaaacatagggaaagcacttcatgacaatggatttggcaatgatctcttggatatggcaccaaaagcacagacaacaaaaaaaatatcgataagttggactacatcaaaattaaaaatttcttttttttttttttttttgagatggagtctcactctgttgcctagattggaatgcagtggtgcaatctcagcttactgccacctccacctcccgggttcaagtgattctcctacctcagcctcctgagtagctgggattacaggtgtgagctaccgcgcctggctaatttttttatttttagtggagacgaggtttcaccatgttgaccagtctggtcttgaactcctgagatcaggtgatacacctgccttggcctcccaaaatgctggcattacaggcatgagccaccgtgcctggccagattttttgaaaatatagtggacaccatgtaactaatacagaaaaattctaaaggaaataaagatgctgaatttccagatttctttataggagatgaaatgaaaaaatcaacatcctattacagttgctggaaaacagatgatgggttttgttagaagaaaatgcccttgaacttgaaccaaggtagttgtacataagccgcccctctgtatctgccttcagtactcagaatttattgccctcaagctgaagaatgttaggctggagatgacactttatttatttattcattttgagatggagtctcactctgtcacccaggctggagtgcaatggcgtgattttgactcattgcaaccactgcctcacaggttcaagagattctcttgcctcagcctcccaagtagctgggattacaggtgcccaccactacacctggctaattttttgtatttttagtagaaacagggttttgccctgttggccaggctggtctcgaactcctgacctcatgatccacctgccttggccccccaaagtgctgagattacaggcatgagccactgtgcccagctgagatgacacttttgacagtaaacagataagcagctggatcctactcaaccagagctataaccaaaaaatcttccgaacagtgaatgacatcacagcaacaacggcctttctaggaattttccaattctgtgttttagattttagaggccctaggcaaaatagtgaaaaaattatcctcagagagcaccccaccaccataagctcttctcccccaaaacaagctgtgtgtgtctccatttcagcacttcatatgggagtctatgcacctaagcctctcccgttctgtcaggaagtaggtgttcctggtcccttccctgcttctgaaggtgatagccagcaaatgccatcactgaatctagactaacacaaattgcgtaaaaatatggccctcctttggccacatactcacatactggcatttgtatttttctattattatttttatttatttgtttattattacttttttttgagatggagtatcacgcttgtcacccaggctggagtgcagtggcgtgatctcagctcactgcaacctctacctcccgggctcaagcgattctcctgcttcagccttccaagtagctgagattacaggcacccaccaccacgcccggttgatttttgtatttttagtagaaacgaggtttcaccctgttggccaggctggtcttgaactcctgacctcaggtgatctgcccacttcggcctcccaaagtgctgggattacaggcgtgagccaccatgcctggcccatactggcattttaaagaaccttctccggtgtcactaagaaaccctagagaaatacagttgatctttgaacaacacgggtttggattgcaggggtccacttacatgcagattttttttcaataaaagctgcactaagtgtgcctgcctctcttgcctcgactcccactccctccacaacttctgcctctgccactgctgggacagcaagaccaacccctcctcttcttcctcctccccctcagcctactcaacatgaggatgatgaggataaagacctttacgatgatccactttcacttcaggaatagtaaatacattttatcttctttatgattttctcaataagcttttcttttctctagcttactttattgtataaatatagtatagaatacttatactaaacatgggtaattgacagttcatgttacaggtaaggcttctgatcaacagcaggctatcagtagttaaggttttggggagtcagcactacgggggttgccagctcagccctcacgttgctcaagggccaactgtactttttttatttattttatttttttagagacagtatctcgtgctgtagcccaggctggactgcagaggtgcaattacagctcacagcagcctcaacctcctgggctcaagcaatcctcctgcctcagcctcctgattagctgggaccataggcgtgcaccaccatgcccggctttttttacttttacttttggtggggtctccctatgttgcccaggttggtctcaaactcctgggctcaatctatccttctacctcggcctcccaaagtgctggaattgtagatgtgagccaccgcattgagcccaactgtatctctcttttttttttttttgaaacagagtcttgctctgtcacccaggctggagtgcagtggcatgatctcagctcactgcaacctccacctcccgggttcaagcaattctcctgcctcagcctcctaggtagctggaattacaggcgcacgccaccacacccagctaatttttgtattcttggtagagatatggtttcgccatattggctgggctggtcttgaactcctgacctcaggtgatccacccgcctcggcctcccaacgtgctgggattacaggtgtgagccatcgcgccccgcaaaaagtactatttctgaaaataattttttgttagatatttaggcgtcacaagtgcagatttcttaacatgcatatattgcactgtggtaaagtctgggcttctagtgaacccatcacctgaatagtgaacattgtacccatgagtagtagatcaaccctcagctcttcttactttcccaccttttgagtctccaatgtctattattctattcatgggtacccatggtccagctctcactaatgagaacatgcaatatttgacttcgtgtttctgagtcatttcactgaacatttcactgaataatggcctctagttccatccatcttgctataaaagacatgatttcattattttttatgcctgagtagtattctgtgacatgggccaggcacagtggctcacacctgtagtcccagcactttgggaggccgaggtgggccgatcagctgaggtcgggagtttgagaccagcctggccaacatggagaaacccgtctccactaaaaatgcaaaatattagctgggcgtggtggtgcatgcctgtaattccagctactgaggaggctgaggcaggagaatcgcttgaaccggggaggcggaggttgcagtgagccaagattgggccactgtactccagcctgggcgacagagcgagactccgtctcaaaaaaaaaaaaaaaaaattaaaaaccttttttttctttttttttaaaatagagatgaagtctgtgttgtccaggctggtctccaactcctggactctctcgcacatgctgaagtgcagtggcatgacctcagctcactgcaacctccacctcccaggtttaagcaattctcctgcctcagcctaccaagtaactcagattacaggtgcccgccaccacgcccagctaattttttgtatttttagtagagacaaggtttcaccatttggccaggctggtcttgaacttctgatctcaggtgatccacccgcctctacctcctaaagtgctgggattacaggcgtgagccaccgcacctggcctcgttcttatgttttcagttttcttgttgctgtggcagaatgacatcaggcacaaacagctgaactgcagcctggattcccatctctgctggctctcctgtcctaaagcctaacatccctgagtgccttctggcaacctgaacatggtggagctgtggcgtccttctccctgatttttattgcaaggcagcaagcaagacacagtcagtaattacctcccgggtaattgcacaacttttgtgttgtgcctcacaagcctggtctccagccacttacatacgtgcaggatggagagtctacgtgatgggatctgccaacccaaagggcatgattggaagataaccggctgggttgtgccagagttttgttttgtgatctcccaaggacacagccttcagagagttagaaccaaaagatcttaaaaagccttgatatttgcataacgaacactgtttgtctcaaatgtttggaataagtctgtagatagaacacaccagattattattgtgtttctagagaagaaacacatggaagttaattatgactatgtaaaattaaaagtaccctgctgaaaggtgacagggagggtgagggaggtagagagaggtggagcccggagctgttgcttttcatgaagattttctgtgcagtttggattaaataataataataataataataatagagggctgggtgcagtggctcatgcctgtaatcccagcactttgggaggctgaggcgggctgagggcagaagtttgagaccagcctggtcaacttggtgaaaccccatttctactaaaaaaaaaaaaaaaaaaaaaaaaaaaaaaattagctgggcatgatggtatgtgaccgtaatcccagctacttgggaggctgaggcaggagaatcatttgaacctgggaggtggaggtcgcagtgagccaagattacgccattgcacactccagcctaggcaacaagagtttaactccgtctcaaaaaaaaaaaaagtagagacagggtcttactctatcccccaggctggagtgcagtggcgtgatcatagctcactgtaaccttgagttcctgggttcaagccatcctcctgcttcaggctcccgagtagctgagactacaggcacgtgccatcacgtgtagctaatttttttttttttttgcagagatagagtctcactatgttgtccatcctggtctcgaattcctggcctcgagcaattgtcccacctcaacctcccaaagtgctgggattacaagcatgagccacccaccacacctggcctacctgtttggaatttttttttttttttgacacggagtctcgctctgctgcccaggccggagtgcagtggcacgatctcggctcactgcaacctctgtctcccgggctcaagcagcctcccaagtagctgggattacaggtgcctgctaccacgcccagctaatttttgcattttgagtagggacagggtttcaccatcttggccaggctggtcttgaactcctgacctcttgatccatccacctcggcgtcccaaagtgctgggattacagccgtgagccaccgcatccggccaagctgtttggctttttaaaaccaggtgcatgtagcaattttgtcacaattttgacaaaattaagcgatatactaaaagataattaaacaattcatttacacccacccacagtcatatagcattaaacagaaagcaacctttggagtctggggactgtattcaaggtgctctgtaaacatccattatattctgctcttattcctttgctgccattgaaggttgaagtcacaccagttactcagcagtctgtttgagaacgtgttcagaaatgagcagagacattcatcaagagaagcacatttgacggggtgagctggagtccatcagacctcacaaccaagggctggcaggagctgagcccaaagaccggcctctccagaaccatctttccgccaagtgagaggctgggaggcagcgtggatttgtcacacaagcgcattgtattttctggccttaaaggaagaagccagctgggcacggtggctcatgtctgtaatcccagcactttgggaggccacctgaagccaggatcacctgaagccaggagttcgaggccagcctggctaacatggtgaaaccctgtctttactaaaaacaaaaattagccagcgtggtggcgggtgcctgtaatcccagctactcggaggctgaggcacaagaatcgcttgaacccaggagatggaagttgcagtgagccgagattgtgccactgcactccagcctgggagacagaacaagactgtctcaaaaaaaaaaaaaaaaaaaaaaaaagaagaagctggggttaatttctgggctggagcaaatagatgcatggcagccgcagactgggccagttgaggatacccctcaccaaaggtcaggcagccccctggctcttccatcctctttgtcagaaagagtattttttgtgatcttctagaattttagatgtgttctgcagaaggctcttcctgaaggagaggattctgaagcaaaagctgtccacggtctccggtctccgcaggggatattagaacatggtgttctaataacagtccttggctgcagcccgagagctgtcaggcttcctcctggggatcagggtgcagttggcgggaagatgaagcaggcttggaaccggaatgctttctacaggcatcctgggaatgtgctctcagcaggccactccgggcactggggacacatggaaccgctgcttttctgggttaagtttcctttttctacaggtaagtcccaagaagaccaccgagactgtcagaatcccacagactttttctccaagggatattcaatcccaaatgaatagaaacttcccatgttcccacagaaggcttttttttttttaattcttagattttattttgtagagacagggtcttgctatattgcccaggctggtcttgaactcctagtctcaagatgtcctcccactttggcctcccaaagtgctgggattacaggcatgagccaccacacctggcccatagaaacgtttttagttaacaggtggaagggaacaggcttaattctttctaaataaacccaagtgtttcaactaatttgttttaaaaagcatcctttaatatgcccaacctttacttttttaaaaatactgctataatgttgtttttccttaaggtttataaacacagcattcaagaagtttcttttccttgtacgattttgtctacaataaagagcatgctgctcggggtgatcatgtggttcaaactgcctggattcagccagatgtggggcaaattaaaagagagatgatgctttttagagtaaaaaacggccgggcgcgctggctcacacctgtaatcccagcactttgggaggccaaggtgagtgaatcacaaggtcaggagttcgagaccagcctggccaatatggtgaaaccccgtttctacaaaaaatacaaaaattagccgggcgtggtggtgtgcatttgtagtcccagctactggggaggctgaggcagaagaattgcttgaacctgggaggcagaggttgcagttagccaaggtcacgccactgcactccagcccgggcgacagagcaagactgcatctcaaaaaaaaaaaaaaaaaaaagaatgaaagtcttggccgggcatggtggctcatgcctgtaatcctagcactttggaaggctgaggcgggtggatcacccaaggtcaggagcttgagaacagcctggccaacatggtgaaaccccatctctactaataatacaaaaattagccaggtgtggtggcacacgcctgtaatcccagctacttgggaggctgaggcaggagaatcacttgaacccaggaggcggaggttgcagtgagccaagatcacaccactacactccagcctgggtgacagagtgagacttcatctcaaaaaaaaaaaaaaagggtaaaagtctttatttaaagacagttatgtgggccagggtagatgttcccacctgtaatccaaacgctttgggagggattggggccaggagtccaaaatcagcctgggcaacaattagactctgtctctaccaaaaaagaaaaaagaaaaaattaggtgggcacagaggcacatgcctgtagtcccagctactcaggaggctgagtggggaggatcacttgagcctgggaggtcaaggctgcagtgagctgtaatcatgccactgcacttcagacaacagagtgagaccctatctctataaaaataaaatataataaagacagtaatggtaaaccaatattttaaaaaatgcttcatttcaaaatgctgtgctttctgaataaaatctaaagaaatggatgtttatccattcgttcaacatatatttatggggcactgctctgtggaagacactattttcagcctggagtacagttatgaatacacagaagctgggtgcggtggctcaagcctgggatcccagcactttgagaggcaaagtgggcagattgcttgagtccaggagtttgagtccagcctgggccatgcagtgagaccccatctctacaaaaaattttagaagtagcctggtgtggtggatggtgtctgtagtcccagttacttgggaggctgaggcaggagaatggcatgaacccaggaggttgaagctgcagtcagctatgatggtgccactgcactgcagcctgggcgacaaagcaagactgaaaaaaaaaaaaaaaaaaaaaaaacagagagacggacagagagaaagagagagaacaatccctgccctccttgaaccaaggctttcaccttctagtggcagaagacaggtaggaaataaacaaacaagcaaaccacaatattagatggcatcagtgctatgggaaagaacaaaacagggaaaggagaggaagcctgtgtgggcatgcgggtgtgtgtgtgtgtgtgcgtgcgtgcatgcatgtgtgtgtgatggtgaggtgggatggaggggctgcaattccaagtagggggtagtcagataaggttttgctgaggacaacatttgagcccaggtgggagggacacagctacgtgcaaatctgggtatgaaacagctggaaggcccgcatgacaggagtggagtgagagagttggagttggaggtggttggggaagtggagggggtggggaaagcaggatcacgctgggggaggggagcacagacaaatcctaccaggccctgtaggccatttcccaaagaggatgacttttctctgggtaagatagggtgttctaacacagaagtgacacaccatctttttttttttttttgagatggagtttcactcttagtacccaggctggagtgcaatggcgtgatctcggctcactgcaacctccgcctcccgggttcaagcaattctcctgcctcagccttccaagtagctgtgattacaggcatgcgccaccatgcccagctaattttgtatttttggcaatacatggtttctccatgttggtcaagctggtcttgaactcccgacctcaggtgatccgcctgccttggcttcccagagtgttgggattacaggcgtgagccaccgcgcccggccaacacaccatctattttagcattaaaagcactgttctgggccaggctccgtggcttgcacctataatcccaacactttgggatgctgaggcagggagatcgcttgaacccaagagtttgacatcagcctgggcaacatagggagacgctgcctctacagaaatagaaatttaaaaaatcagccgggtgtagtgttgtgcacctgtagtcctagctactcaggaggctggggtgggaggatcacttgagcccgggaggttgaggctgcagtgagccgggatcatgttattgcatgctagcggtggcaacagagcaagaccctgtcttaaaaaaaaaaaaaaatgctggccgagcgcggtggctcacacctgtaatcccagcactttgggagcctgaggcaggcggatcacgaggtcaggggattaaggctatcctggctaacacggtgaaaccccatctgtactaaaaacacaaaaaattagctgggcgtggtggcgggcacctgtagtcacagctactcgggaggctgagacaggagaattgcttgaacccgggaggcggaggttgcagtgagcaccaagatcgcgccactgcactccagcctgggtgacagagcgagactccatctcaaaaataaaataaaattaaaattaaaaaaaagcaccgctctgctctgctgctgttttgataatagagcaggcttgagagtgtagaatccaaagctgggagttgagctaggaggtgtttgctgtaatccaagaaagaccacagcagcctgaatcatgttggtgataagtagtagaaaaaatcagaatgaacgtagacttgacaggatttaaatgtaagatgtgaaagaaaaagaagattcaaggatgatcctacattttgggccctggcaatgtggaaaaaaaaaacaagatctcaggaccctgaactggctatgccaaagggaaagttaagcttgggaagtgagtcatgcaaaaactgccttccttttgtccctgaacagatagcaatagtaagctgtaattttacatgcttactttatcttatgcaaaatgtagatttactgagcatgagatgaatgcataattgccattttctctgctccctcctttcatgtgtaaaatgtagattcactgagcactaatcaaagcctcacaagaatgtaaatgattatttgccttattacctatcctccatccatccacgtttttccttcttttttcttttctttttttcttttttttttttgagacgggatctcgctcttgtctcccaggctggagtgcagtggcgccatctaggctcactgcaacctccacctcccaggttcaagtgattctgcctcagcctcctgagtagctgggattacaggtgcccaccatcacgcccagctaatttttgtacttttagtagagatgggatttcaagaccagcctggtcttgaactcctgacctcaggtgatccacctgccttggcctcccaaagtgctggaattgcaggcatgagccaccacgtctggcctcttttttcttttttaaaaacaaagtctcattatgtcacccaggctggggctggagtgcagtggcgcaatcgtagctcactgtaacctcaaactcctgggctcaagccatcctcctgtctctgcctcccacgtagctgaaaccacaggcacacgccaccatgtccagctaattttaaaattttttatagagacgggatgttgctatgttgcccaggctggtctcaaattcctgggctcaagcaattcacctgccttagcctcctcaggtggtgggatgtgaggcatgagctaccgcatctggcctgccccactttttttcctttcctccttctcctcctgctcactccttcccatttaaatattgaagtgcttaaaacctctttggaaaaagcacggatcacagatgctcctgtgatttgtgttttttcccaagcatatcctcaaccttggcaaaataaacctccaattaattgagatctgcttcagttacttttttatttatagcaacaattttagtgagctcaggctgccataacaaaatatggtgactggatggtttaaacaacacaaatttatttctcacagttctggaggctgggaagtccaagaccaaggtgccaggatagtctgtttctagttaggactctcttcctggtttgcagacagctaccttctcccctgtgtccttacatggtggagggagagctctggtgtctcttctttttttataaagacaccagttctattggatcagggctgtatccttatgactttgtttaaccttaatcacctccctacaggccctatctccaatatggtcaaatgaggggtcagggattcaacatatacatttgggatgggagacataatttagtccatagcagcaaccaaaaggatggacttgccatttaccgaaatgagaagtcgagtgagaagcgagttttgaaagaaagggcaaaaggtccatgtcggacatgttaggcttgagatatctgttcatcaagccagttggttataaagtttggaattaaaaggacaggtcttggctaaaggtatgaaattgggaggcatcagctcattggtggccaggatactagagtagataaccagaagtggaaaggacccaaggcaccccgacaggcagagtttggggtgaggaggacaggacaagagacataaaaggagcagccagggacataggaagaaacctttgagtatgcagtgtccctgcagccaaatgaagataattatgtagggaagagggagtgatcaactgtgccaagagccccagagaggtcaaggaagaggaggactgggaattgagtcttggatgtagccccatgatggccactggggattttttttttttttttgacagagtcttgctctgttgcccaggctggagtgcagtgatatgacctcggctcactgcagcctctgcctcctgggttcaagcaattctcctgcctcagccttccaagtagctgggattacaggtgcccaccaccatgctcggctaattttttgtatttttagtagagacagggttttaccatgttggctaggctggtcttgaactcctgacctcaggtgatctgcccacctcggcctcccaaagtgctgagattacaggtgtgagtcaccacgtccagcctttttcctttccttttcttttttttttttgagacagaatcttgctctgtcgtccaggctggagtgcagtggcataatctcggcttactgcccccactgcccagattaaagcgattctcctgcctcagcctcccgaacagctgggattacaggcgcccgccagcacacctggctaatttttgtatttttagtagagacggggtttcactatgttggccaggctggtctcaaactcctgacctcaggtgatccacccaccttggcctcccaaagtgtctcacccatctgagccctcaccattgtactctcttccctgggttttgtgaagcagggaaactgaatttagtctttcccataggatcttatatcatttacatcttgcttctgatacaaaacttcagttataaaattttcactaaatgccagaaaatgttttcttttaagggacctgtctttcattcagggaaagcattttcaaattcttcagcagacgacttgaaaggagcttcctgtctgacttcagaggcactcccagccaggcgcagccctgccctgggcacagactcactgcccatcctcacagaggccctttccttccgcaccaagggcacctgctctgaagctgaccccgctgaaggctggggaacaatcacaggtgtcgtcagtcagcatccagaaaaacgagtcggagaggagaaagggcatgtaggaaatggaaccagtcattctattgtctttgacttggtacattttcctctgccgctactcccatcttttgtcttttgtggtttgtgatacttttctctttgtctctcgggaggccaagttgactaaaatcatgaaatggggctggtcacattggctcatgcctgtaatcccagcgctttgggagactgaggtggaaggaccacttgagcccaggagttcgaaaccgtgatcatgccattgcactccagccagggtgacagagccaggtcctgtctcaaaaaaaaaaaaaaaaaagaaaaagaaagaaattcaatctagtccaagtccctttcacatcatagatggggactcttggggcccagggaggttatctcactgcctcagtcactgagcctgctcgtagaagaaccgggtgtagatccaggctcctgccttcacagctttatctgatgccccaaacctgaataaactcagcagggagctggcgggctggttcttgaggggctcagaggtcactgcctaggtctggggtcactccaatgccaggagcggcctgtaccctcagctcactcaggggaacaattgtgccatttattttattttatgtatttatttttggagtgaggccttcctttgggtggcatttattagtagcactatttatcccgtgtctactgcattgcatgatctcaagtgctttgcctagagtttctcagttttcacccaagctctgcaaaactctatcagttctatttgacacaggaggaagtgttaagcaacaaggtcaagatcacacattagtgagtggggaggctaagaatggagcccagacgtgtctcattccaagcctgtgatggttccatacagacacaggctccacaaattcacactgtctcaagactgagtgtagacagtggccagtgcaaatgcattcatctccctggaaggcatgtataaccgtgtataaccacacgacttgtttcaaccagtcatcacagcctctccccagtgagaaaactcacttggaaatgcaaattaagatgggaaagttacttattgaacataaagacagaacaaaggaaaccccatatccttagaggaacctattatcaaagcgatagcctagtgagacagcagcctcccttgtggggccggctcccacccctgcctagctggtgggaggaggtgtgtcagcctgccccggtgaccgctctgacgtggcgcatcactggagtcacctggcaaactcttaccctgactctgtcctttgtgaccacattttcacagctgtgattcagtctcccttccccagtaacatttcagaggagtcacaactcagggctcattttgcagtgggtacattttaaggagtcgctttttttgttgttttgacagagccttgctctgtcgcccagggtattgtgcaatggcgcaatctggactcactgcaacctccaaagaaaccacttcttaatggaatctagggatggtccctgcgcatctccagacaatagttaggcagcattacctctgggaaaagattagctttctaaatctcatttactgtaaatgcattcaagtacatgtcaaagacttcggaccttgcttgactggaatcccatagccaacaggaaatccaatttctgtaggtctgtagtagccactgtttactattgacacccagagttattgtttgtctcttttgtttgctttcaatgatagcatgtgcttctgtcacaacaaacagcatttaagggaagacgctctcctcccaaccttgacatctgatcctcagttacacactgacatttagttattttcaattaaaagtgacaaactgtattccaaaaagtgattatgtgcctccaggtctaccacagacttttttgtttgtttgtttgtttgttttttgttttttgtttttttgagacggagtttcgctcttgttgcccaggctggagtgcaatggcgcgatcttggctcactgcaaactccacctccctagttcaagctattctcctgcctcagcctcccaagtagctgggattacaggcatgtaccaccataccctgctaatttcgtatttttagtagagatggggtttctccatgttggtcaggctggtctcgaactcctgaccttaggtgatctgcccacctcggcctcccaaaatgctgggattacaggtgtgagccactgcgcctggccctacagacatttttttagatgttaaacttcatgctcacttcggcaccacatttattaaaattgcaatgatacagagattagcatggctcctgagcaaggatgacatgcaatataaaattcaaatcgaaaaaatgtttaagttaattccatttcttatctaagccttcattctccctctctcatccagctcttggccctaaggtctccgtgaacctggagaggaggcaaatctcaaatccatttggcttcctgacagtaggtagatctgacaaaggatttagtatcaaatgtaattgaactaatgggcaaaattctggtttttgattaagttaggatattaggatctggagttgcattgtctgatataatagtatggatgaaaagagtcaaactctgtaaaatatttgaagagatttgttctgaaccaaatatgagtgaccatggcccaacacacaattgtgggagatcaagagaatatgcacccaacttggtcgggctacagcttggtttcacgttttagggagacatcacaaaacatcaatcaatacatgtaagatgtacattggtttaatctggaaaggcaggacaactggaatccaggtttttgaaacctggattacacttacctgggtagtgtcagaggcatttgaacaagagcaatttcatcttgaatacgggctgggtaaaataaggctgagacctactgggctgcattcccaggaggttaggatactctaagtcacagcatgaaataggagatcagcacaagacacacgtcccaaagactttgctgataaaacaggttgcagttaagaagtcagccaaactcggccgggtgcggtggctcatgcctgtaatcccagcactttgggaggctgaggcggggcggatcacagggtctggagatcgagaccatcctggctaacatggtgaaaccccatctctactaaaatacagaaaattagccgggcatggtggcggacgcctgtagtcccagctactcaggagtctgaggcaggagaatggtgtgaacctgggaggcggaacttgcagtgagccgagattgcgccactgcattaaaaataaaaattaaaaaaaaaaaaaagaagtcagccaaactccaccaaaaccaagatggcaatgaaagtgacctccgctccttctcactgctcattatacgctaattataatacattagcatgctaaaacacactcccatcagcgccatgacaatttacaaatgcctggcaacatcaggaagttaccctatatggtctaaaaaggggaggagtcctcagttccgggaaatgaccaccgctttcccagaaaactcatgaataagccacctcttgtttggtatataatcaagaagtaacggccaggtgtggtggctcacgcctgtaatcccagcactttgagaggctgaggcaggaggatcacttgaggtcaggagttcaagaccagcttggccaacatgacaaaactccgcgtctactaaaaatacgaaaattagttgggcgtggttgtggacgcctgtaatctcagctactcgggaggctgaggcaggagaatcacttgaacccaggaggtgaaggctgcagtgagccaagatcatgccactgcactccagcctgggcaacagagcaagactctgtcgcaaactctcccccaaaaagaagtaacaataagtataagcagttgagcagcctgtactgctgctctgcctgtgaaattgttttgttgttgttgttgttgttgttgttgttttgagacagagtcttgctctgtcccccacactgaagtgcagtggctcgatctccgctcactgcaacctccacctccccggttcaagcgattctcctgcctgagcctcccaagtagctgggattaaaggcaccagccatcatatccagctactttttgtttttcgtagagttggggttttgctatgttaggcaggcttgtctctgactcctgacctcaagtgatctgcccgccccggcctcccaaagtgctgggattataggtgtgagcctctgcgcccgcccttgtttctttccttctctaatacacttgctttcactttactctatggattcgtcttgagttctttcttgcacaagatccaagaaccctctcttaggatctggatcagatccttttctggtaagaataggcagattcaaagattttctgattggcaattggttgaaagagtttatctaaagacctgaaatctatagaaggaagtgttgaggttaagacaagacagtgtggagaccaaggttcttaatactcagatgaagcctccaggtgggaggcttcagagagaatagatgggaaatgtttcttatcagacttaaaaatgtgccagactcttagttaatttctcctggatcaggaaaaagacctggaaagggaaaaggatctctatagaatgtagattttcccaactgacagctttgcagagccgcttccaaatacatggaagaaatgtatttcagggtaaaattcttcaatttatttcagagcctgctatctatcacattggtattatatttctactaagagtctgtttggtcagtcttaagctctctgttttaatgttaatgctggttgttgtacctgaattccaaagggagaaaggtagaaggaggcatgtccgaccacccattcccatcatggcctgaattagtgtttcaagttaattttagaatacccttgaccaagaggaaaggtctgttcagctggttgtgggggcgggcatagaattttatttttggtttacaatagccactagtactggtggctatttaaattaaaattgttgaaaatatcataacattacaagttcagtcccttggttacagtagccttattgatatggaaaggggttctgatttagaccctaagagagggttcctagatcttgtgcaagaaagaattcgaggtgaatccatagactaaagtgaaagcaagtttattaagagagtaaaggaggccaggcgtggtggctcacgctataatcccagcactttgggaggccaaagtgggagactgaggcaggagaatcgcttgaacctgggaggcggaggttgcagtgagcgaagattacgccaccgtactccagcctgggcaacagagcaaaactctgtctcaaaaaaaaaaaaaaaagaaagtgaaggaataaagaatggctactccataggcagagcagtggcatgggctgcttgactaagcattcctatagttatttcttgatcgtatgctaaacaagtggtggattattcatgagtttttcaggaaaggggtgggcaattcccagaactgagggtcctccccttttttagaccatatagggtaacttcctgacgttgccatggcatttgtaaactgtcatggcactggtgggagtgtcttttagcatgctaatgcattataattagcatatactgagcagtgaggacaaccagaggtcactttcattgccatcttggttgtgggttttggccggcttctttaccacagcctgttttatcagtaaggtctttatgacctgtatctttttttttttttttttgagacagaatctcactctgttgcccaagctggagtgcagtggcatgatcttggctcactgcaacctcgcctcctgggttcaagtgattcttctgcctcagcctcccaagtagctgggactacaggtgcatgccaccacgcccagctaatttttgcgttttttagtagaggtagggtttcaccatgttggccagcctggtctcgaactcccgacccagtaatctgcctgcctcggcctcccaaagtgctgggattacatgtgtgagccaccactcccggtctatgacctgtgtcttgtgccgacctcctatctcatgctgtgatttagaatgcctaacctcctgggaatgcagcccagtaggtctcagtcttattttacccatcccctattcaagatggaattgctcgggtttaaacacctctgacattatttcaagtgctcactaaacacatgcagctcgtgtctaccatcttggatagatcagatgtagaacatgccaacacttccatcgttgcagaagtttctattagcactattctggagggcccaggagctggatggcacagacattttgtctcccctggagatggctcaggagctattctgagcttcttacaggcttctgactctccacagcttcacctccaggcgctaagccactgtttcctctgcttggaacatttcatccattcccacctcatacccttcaactaactccagtaaggtccctccttagaaattactccctccaagaaggcatccctaacccccaagtgtctagatcatggctgctcatttggctgtccctatatacccccagcccatttcccccatcacagcatcacatcactaggtattataatgatgtgttcatctgtctgtatctctcattcctccattcgctcattcatttattgagcactcattaattgccaggcactgtgctagagactggggataccctggtgaacgaggcgggcatagtccctgccctcacatactatacagtgtaaggcaggggccacagcagccttgcccatagcttattcctatctatgtgctaggcacatagtaggtgctcaatatatatttgttaacaaaataaatggaaagtttcttaggaatgggctgttctgactcctccttctgggtgaaggctgagacacaggtagtgcatggaaaaaatgaaaacatggccgggcattgtggctcacgcctgtaatcctagcactttgggaggccaaggcaggcggatcacctgaggtcaggatttcgagaccagcctgggtaacatggtgaaaccccctctgtactaaaaatacaaaaattagccaggcgtggtggcgtgtgcctgtaatcccagctacccaggaggctgaggaggagaatcgctggaatccaggaagcggaggctgcagtgagctgagatcgtgccactgcactccagtctgggtaacagagcaagacttcatctcaaaaaaatagtaagaagaataaagaaaaaatgaaaacatcaaaacctatgactatgaaagttggttaatagcatccccccaaaattcatgtccatctagaatctcagaatgggatcttatttggaaatagggtctttgcagatgtaattagttcagatggaccctaaatccaatgactagtgttcttgtaagaagaggagaagacacacagagactaatagggaaggccatggaaagatggaggcaccaggtgcagtggctccagcctgtaatcccagcactttgggaggccgaggggggcggatcacctgaggtcgggagttcgagaccagcctgaccaacatgcagaaaccccgtctctactaaaaatacaaaattagccgggcatggtggcacacctgtagtcccagctactcgggagtctgaggcaggagaattgcttgaacccaggaggcagaggttgcagtgagccaagaccgtgccattgcactccagcctggcgaccaagcaaaactccatctcaaaaaaaaagaaaaaagaaagatggaggcagagccgggagaggtgcggctacaagctggcaacatcaaggactgctgcctgagatagaagtcagcccttctccaggaacccgggaaggctggcgagggggtcagccttggggtgcaccatagccacctcctgccctttcagactttggcacataacactccccgcctttcctgaccagaggctgacatggcctctgaaaagcatctaaaggaaaaactgtgttcagtacaattgtacagacatagtgtacgggaatgccagatgcatcgtcaaagctatcacagtaatatggtgtatccattttatatatgttaccaacttcaattcattctttaatgtattttcatactatttcccatcatgtaggtttcagctaacaaagtcagcaatcaaggtgttactctaccagttgggatttaatataaacttcaataattccttcctcctccccaagtaatctcatggtggaccatgcgaagggaaggaagatctctggggacaaggtggccttccccaggcccttctgttgcctccaggatggcaatagaagcagtgaatggtgttagattctggatctactccaaaggttgagccaaaagcacttcctggtggatttggatgtaggatgtctttatctcacaataaaggaaggagttaagaatgattccagccgggctcagtggctcacgcctgtaatgccagcactttgggaggcctaggcgggtggatcacaaggtcaggagatcgtgaccatcctggctaacacagtgaaaccccatctctactaaaaatacaaaaaaaattagccgggtgtagtggcgggtgcctgtagtcccagctacttgggaggctgaggcaggagaatggcgtgaacccagaaggcggagcttgcagtgagcagagattgtgccactgcactccagcctgggtgacaaccatctcaaaaaaaaaaaaatgattccaaggccgggcgtggtggctcacgcctgtaatcccagcactttgggaggccgacgtgtttgagaccaacctgaccaacatggagaaaccccatctctgctaaaaatacaaatattagcagagcacggtggcaggtgcctgtaatcccagctactcaggaggctgagacatgagaatagccgggcgtggtggcaggcgcctgtaatcccagctactcaggaggctgagatatgagaacagcttgaacccgggaggcagaggttgcagtgagatgagatcacaccattgcactccagcctgggcaacagaatgagactctgcctcaaaaaaaaaaaagaatgattccaaagttttttacctgagcaagtggaaaaatggaattgccattaatttagatgaccaagagtgtccgaattttttcatgtagcattgactatgtttgtttgtttgcttgtttgttggagacagggtcttgctctgttgcccaggctggagtgcagttgtgtaataatggctcactgtagcctccacctcctgggctcaaacgatcctcccacctcagcctcccaagtagccggaactacaggcacacaccaccatgcccagctaattcttttattttttagtagaggcaaggtcttgttatagtgcccgggctggtctcaaactcttggtcttaagtgatctgcctgcctcagcctctcaaaatgctgggattacaggcatgaaccactgcgcctggcaacatcatttctgaaaaagtaattttcagaaattttcctttcctttcattcatatctgataatggaagctaataatgaggaagaataaaacattacattaagaatattctccagtgtttgaagctacacacggtttcaaccatatgcatcttttaatctgattttttaaatgtatcctatttccaaaatgaaaatagacgtttgcttttcatgacaactgcagaaaatgaagtaaaatctaaatcccagacctttcatttagtaattgtctgtcagtataaaggcagaaagacagtaattttctatcttgtatattatatcttggggaatgacagttcttttttattcagatctaacttcacatggcaataatactgaaatacattaaaagcacacagtcagatatgatctattcaaagaggaaagaaatacttttctgaagtgtttttttattcaaaagactatagtcttattttttgagagtaaaatataacataataaggccggtgctgtggctcacacctgtaattccagcactttgggaggctgagcctggaggatcacccgaagtcaggagttcgagaccagcctggccaacatggtgaaacccctgtctctactgaaaatacaaaaaattagccaggcatggtgacagacatctgtaatcccagctactcaggaggcttaggcaggagaatcacttgaaccagggaggcggaggttgcagtgagccgagatcatgccactgcactccagcctgggtgacagagcgagacgctgtctcaaaaaaaaccaaaaacataataggacaattcttcaaatgataaagtgaacctttatgtacttatacagctttagctatgattttcacaaatacaaataaactatgccaaattctaagagtctgtgtggatttatgtgttggttatctacagctgaatcattatttaattaattaatttatttgcttctgccccttccccagctgattatcattattattaatttgccaaatgattttcacctatggatcggaaaattgtatttattactgtcagaggcgtttgaaccagagcaactccatcttgagcaggggctgggtaaaataaggctgagacctattttaggaactgcattctcaggagggtaggcattctaagtcacaacatgagataggtcagcacaagatacgggtcacaaagaccttgctataaaacaggctgtggtaaagaagccggccaaaacccaccaaaaccaagagggcaacgaaagtgacctctggttgtcctcactgctcagtatatgctaattataatgcattggcatgctaaaaagacactcccaccagtgccacgacagtttacaaatgccatggcaatgtcaggaagttaccttatatggtctaaaaaggggaggaaccctcagttccgggaattgcccacccctttcctggaaaactcatgaataatccaccacttgtttagcatatgatcaagaaatgactataaaaataggcaaccagctgggatcggtggcttaccacgctgtaatcccagcactctgggaggccaaggcgggcagatcaaccagctgggcgtggtggcttactgtgctgtaatcacagcactttgggaggctgaggcgggcagatcacttgaggtcaggagttcaagaccagcctggccaacatggtgaaaccccatctctactaaaaatacaaaatttagccaggtgtggtggtgggcgcctgtaatcccagctacttgggagactgagacaggagaatcacttgaacttgggaggttgcagtgagctgagattgtgccactgcactccagcctgggcaaaagagcgagactccatctcaaaaaaaaaaaaaaaaaaaacggcaaccagcagcccttggtgctgctctgcctatggagtagccattcttttattcctttacgttcttaatacacttgctttcactttactctatggacttgccctgagttctttcttgtgctggatccaggaaccctcgcttggggtctggattgggacccctttccggtaacattaccattatacacattatgtgtgaatttcatgcatgagtcacattaattattggtataatatgcgtttttacttttaatttttgttgatttttaattgatttttatttttttgaggcagggtcttgctccaacgcccaggctagaatgcagtggtgtgatcctagctcactgcagccttgatctccggggctcaagtgattctcctacttcagcctccccagtagatgggactacaggcacacaccaccacatccagctacttaaattttttttttcttttaataggacagggtcttgctcttgcccagactggcctcaaattcctgggctcaagcaatcctcctgccttggcctcccaaagtgctggaattacagatttgttgagccaatgtgcccagcctaatacgcagttttatgtttcaactttaattcactcattaaacgctaagtatgccctttggactagatttctggggacaaatacccaaaacctcattaattatatcccttgctaactttttctagctggtcttatcagtcatttgagtacttcctccacccttagccatttgctcagtcctgagacccctgagccatcctgtccaccacgacatcaaaagcacaaggacaatgcctgatttagccctgcacatggaaatagactaggtgcgcgcagtgctgagcagggtgatcccggaggcaagaggagggaagagcattctcagttaagtagaggccttcctgaacctctccaaattttatttccactagaagtatctagaagtattttctctcggtttttgtcttatgtttatctatcttttttttgagacagagtttcgttcttgttccagctaaggctggagtgcagtggcacaatctcggctccctgcaaactccgcctcccaggttcaagagattctcctgcctcagcttcctgagcggctgggattacaggcatgcgccaccacaccgggctaattttttgttttttttttagtagagatgggggtctcaccacgttggccaggctggtcttgagctcctgacctcaggtcatttgtccacctcggcctaccaaagtgctgggattacaagtgtgagccaccgcatctggactatgtttattttttttaaaaccaagtttgctcttagatattcaatttccatggtattggtttaaaataattatcagacagggcgcagtggctcatgcttgtaattccaccactttgggaggctgaggcaggcgaatcacctgagatcaggagttcaagaccagcctggccaacatggtaaaacccctgtctctactaaaaatataaaatattagccaggcatggtggtgggtgcctgtaattccagttactcaggaggctgaggcaggagaatcgcttaaacctgggaggtggaggttgcagtgagcgccactgcactctagcgtgagtgacaatctgagattctgtctcaaaaaaataaagataaaataagtaaaataattatcaacctattatggatgcaggtaccccacctcccatgggagcagacccttgcatgtctgaactaaccgagttccgagaattatacagagaggcggcacactgggttggtggggagcatgagcttcggaataaagcagagctgaacttcagtcccatccttgctgctcaccagctctgttacttgctggacctcccagttccttgtctgcaaaatagcaaacctgatcactaaggtaaggaagcatctgccaacccacagtaggtacattaacatcagattattgcctcataatgtcgtttggaggactgaattgatatttgctcaaacatcttgtaaactgtaaagtgctataggaactttttagtagcaacttatttaggctgctgggaggcccttgaggtggaagaacctagaaaaggtaaattgctctcttcagtccccaagtgcctggttcactgccaagaaaccactcccgaactcaggctgctcacctgggctgctggcaggaggaagcagccccagaacggagccaagccagagccggagaaacaggttcctgccttctccgctgacagcctgaggctcatgctctaatctgcaaaaatggcagaagtcgctgtagtgttgtagaactgaactggggttggctccctggtgtggtaagaccagatatttatattgacctggatagtgggagaaagcaaagtgtttatttgtagggagccaagtgaggaggaaagggagtccccacctttctgatggcttgtagataaggattttttttcctttttttttttttttttgttttgagacagggtctcaacgctgttgcccaggctggagtgcagtagcatgatctcggctcactgcaacctccacctcccaggttcaagtgattcttgtgcctcagcctcccaagtagctgggattacaggagctcgccaccacgcccagctaatttttgtatttttagtagagacggggtgtcaccatgttggccaggctggtctcgaacttcggggctcaagtgatccacccgcctcagcctcctaaagtgctggggctccaggtgtccactgccgctctggcctaaagtggcttttaagaaaagttgccacctagagtatggcatgctccataccttggcattttgctctttgctcgcctggttccactggaagctcagcaagctcacaggttctctcccacaccctgactcaggtcccacgtccatttcctcaggctccagagaaagtcctcacccctgggcctccccaggaccccggggacactgtacagggaagacacattggagacaacagccatggtagtcacagggccctcaacagtgacatcaattatataaggtttgatggcctcactttctcactataaagcaaagaatgctgcccatctggcagccagggaaagttctggagttggggacccggccatcctgtggtgctgcctcaggctttgacttggagactcactggggctcgggagatagccagcctggagctgcctcctcttcctttgctttgacagtgaccggatgcccccatcacccagttggcctcacccatactgggccactgcagcccaagcctgtgtcaccagcctccttccagactccccctccaccagtcggtgacaaattgaagtgtcccagaggagccagtatttgctccaaaggaaggctgtgtggttgtttcctacctctagtgcaacatccaggctagaagaagtatcttttgtgttgattcacacatgtcctcactaacctacttatcagaaagtgctctcaaagccacagagcattacccaaatataaagtggtattttgattgctgtggccaaactgctggcatccaaatgagtttttccgcaggatttcacaatctttctcctccaaaagcatgtgattttagagagcacaaggtgtgtacttattttaaaatgcaggaaattaaaacgattttatttttggaatttcacaatagctcttggaataattcaagacgcctgggggtgtcctaaaatcaaggctgggaatcattgatttaaccacttcaaaattagcataaatagggctgggtacgcagggggacttgaaaatctagttcgaattttttttcagcactctatgtctataaactagcctgggcaaggaaaggtggggtaaggaaaaagagaagaggactcaagatttgataaacataattctcttctctggtcagggtctctgggaacattgttttttccaattagtcatcaggttttttaaaaatttagtttaggccaggtacagtggctcatgtctgtaatcccagcactttgggaggccgaggtggacggatcacctgaggtcaggagttcaaaaccagcctgcccaacatagtgaaaccccgtctctactaaaaatacaaaaatctgccaggcgtggtggtgcgtgcctgtagtcccagctactcggaggctgaggcacgagaatcacttgaatccgggaggcggaggttgcagtgagctgagatcacaccactgcactccagcctgggcaacagagcgagactctgtcttaaaaaataaaagcaaaaacaaaaaatttagttcaggccaggtagggtggctcacacctgtaattccagcgctttgggaggccgaggcgggtggatcacttgaggccaggagttcaagaccagccaggccaacatggtgaaaccctgtctctactaaaaatatcaacaattagctcggtgtggtggcgcacgcctgtaatcccagctactctggaggctgaggcatgaaatcacctgaacctgggaggcagaggttgcagtgagccgagatcatgccactgcactccagcctgggtaacagagcaagactatgtctcaaaataaataaataaataattcaatttatttttatagagttggggtcttactatattgcccaggcaggtcctgaactcatggcctcaagcaatcctgctgccttggcctcctaaggtgctagggttacagaggtgagccaccgctcccagcccatcatcagcttgaggaggagcttctgttttctcctttccctcttagccactagaggtacccatgggtgcagtccttctttatcttgtctaaccctcaaagctgtgcttgtccagctcgccaggatgaaccctgctgccataacccagccaccgtgagtcatcaacctgatgaagtgcacagaacccagaggaagaggagagacccacttacacccagggaaaggagagatgcctgcttatacccaggtctcctgttaatgagcttccttttagctctctttctttttttctttttttcatttttttagactgactctcgctctgttgcccagactggagggcagtggcacgatctcggctcaccgcaacctctgtctcctgggttcaagcgattctcctgcctcagcctcctgagtagctgggacccaggcacacaccaccatgcccagctaatttttgtatttttagtagagacggggttatactgtgttggccaggctggtctcgaactcctgacatcatgatctccctgcctcggcctcccaaagtgctgggattacaagcgtgagccactgcatcccacctttcttttttattcttgtcttgatattacttcttcaaggattctacaccgcatagtctcaggacacactttcaagggtcaggagtggtctctagattctccctctcctcagtcctgtccgatttcccaaggcaggcccagccaggcactcccagaggcagcctcatgtgggctgagggctcaggccttcccagcctcactccctggatggtggtggaagtggccagctgctgatgcctctcaggagccctttctggctgtgcatgcagtgagtccaggcgtgactgacagcctctgagctccggttgcccgcctggcacctgggtccctgaccacaccaggatacagtgctcattctgcactggagtccgaggcagctggggaaaaggggcacagtggctggacacagcagcatgcacctgtagtcccagctactcgagaggctgaaggaggaggatcatgagtttgaacccagcctggacagtatggcaacaccccatttccaaaagaggcatcttcccctgcctctcctcttagccattttctttttctttcttttatttttatttatttatttttggagacagggtcttgcggtcaccctggctgtagtgcagtggctcaatcatagttcactgcagcctcaacctcctgagctcaagggatcccctgagccttcccgagtagctaggactacaggcatgcaccaccatgcccagctaatttaaaaaaaaaaatctttgtagagagggagtctcgctatattgcccagactggtctcaaactcctgggttcaagcgatcctcctgcctcagcctcccaaagtgctgggattataggctgagatgccacactcagcccaatctctttctttcttcagaaagtgatttttataatttgcagcaatgttttcactatggaagctcttttccctaaccatccatttccaaaagtgaatttcaacagaaaaaaacacaacgtacatcagtcaccaatgtgcccagggtctaatttgtgaataaaagagtaactggactggggtcaggccctgtgtgcatttgggatgtggtgggggctgctctctctgctgagtgccagagtgagggtagttagcaagtcaacgaggagaaaaggaactcatgcctttccactctgggacagtgaaagtgaatgtggacttgacactgtatggtgtccccattgatcagtgatctttatttttttatttttatttatttatttatttatttttgagatggagtttactcttgtctcccaggctcgactgcaatagcatgatcttggctcactgcaacctcggcctcccaggttcaagcaattctcttgcctcagcctcctcagtagctaggattcaggcacatgtcaccacacctggctaatttttgtatttttagtagagacggggtttcaccatgttggaccaggctggtcttgaactcctgacctcaggtgatccgcccacctcggcctcccaaagtgctgggattacaagcgtgagctactgcacccggccgatcagtgatctttataccattaaaacaaacaaacaaacaaaaaactgtgaacctctaaagttaattaaatataaagttgttctggaaagttctcccttgccctgcagattccattaaaagcattcctggctgagcacagtggctcacacctgtaatcctagcactttgggaggtcaaggtaggcggatcacttgaggtcaggcattcaagaccagcctggccaacatggtgaaaccccgtctctgctaaaaagacaaaaattagccaggtgtggtggcgcgtgcctgtaatcccagctactccatagggtgaggcaggagaattgcttgaacctgggacatagaggttgcagtgagctgagatcgcgcgactgcactccagcctgggtgacagagcgagagtccatctcaaaaaaaaaaaaaatccttgcagttcctcctgggcttccactttgtgttccgtgatctgccatccagctgacatggaagccagacatgcccaagggagccccggctgcctgtggccagttcactccagtgtgtccgttttcaaaggtaacacagacccctgctgggctgatgctgccctttagagctctctgtgacaaacggtcctttcttcctgcccccgttctgttcctttgctctccagggctggttcatcacagagcttctcacaccaaacacaaagctttagattaggcaggttgttaaaaaaaaaaaaaaatatatatatatatatatacacatatatatatgcatacatatgtgtgtgtgtatctacctatctatctatatttatatatatataattttttttttagctgcaaaactgctataaaaatgccactgggtgtatgcaacttctgccttccttcatggccacctctccctggggagagtctcagccagctctctgaccaaagactcagtgcaatttcagaggactgctgttaggatcatcaagtttcaaacgttgatacagatctggatcttcagggcccttgggaaaggggaagtgaggggtatgagcttgtaagaaggccctggggaagaaggcaccagctttccaagggcctttctttcctaattaaagacatagctccctgcctaccctctacttaggtgcggcaagtgagatggcttctctgcagcccttagaataaaggagtaagaggaaaaccaaagtttccgagaatgttccgcctacccctcatgaaaatggcaatgcatcctattgcttgataatgctagaagttggctctatttaaaaaccacaaaaccttttttttttttttttttgagtcagagtctcactctgtcacccaggctggagtgcagtggtgccatctcagctcactgcaacctctgcctcctgggttcaagcaattctcctgcctcagcctcccgagtagctgggactacaggcacccgccaccacgctcggctttttgtatttttagtagagatggggtttcaccatattggccaggctggtctcgaacccctgacctcgtgatctgcctgccttggcctctcaaagtgctgcgattacaggcgtgagccaccacgcccggcccacaaaacctttttcttttttatacttttttcttttttgagacggagttttgctcttgtcacccaggctggagtgcagtggtgcaatctcggctcactgcaacctccacctcccagattcaggcaattctcctgcctcagcctcctgagtagtggggattacaggtgtgcaccaccatgcctggctaatttttatatttttagtagagacagggtttcaccatgttggccaggctggtctcgaactcctgacctcaagcgatccgccctccttggcctcccaaagtgctgggattacaggcatgagccaccacactgcataaaattctattgaatagttccccataaggtaaagccactttcccaacagagcatttaaaaccacttccattcccagcatctctcaccactaagggatggatttggggggtaggtttcacctatcacctgaacttttgtccctcgttgatttggaactgagtggagggaggcagcgtgagaggcctgcgttttgcaggtgttggttgtggagtgcaggctggcctgccgctgacggctggggcagtggccatctggcacagcggtccctggttttggtagtggctgtcattcccttggtggctatttctgagtgcacttaggaacctgtgtggaagcacagcctagagtctccctcttcaggtctccccatgagtcctgcagctgtagatatttctgtttttattttctttttctttttctttttctttttttttgttttttgagatggagtcttgctctgtcacccaggctggagtgcaatggcgcaatctcggctcactgcagcccccgtctctcgggttcaagcgattctcctgtctcagcctttcaagtagctgagattacaggcacacgctgccacgcccagctaattttttgtattttagtagagatggggtttcaccgagttgcctaggctggacttgaactcctgagctcaggcaatccacccgcctcggcctcccaaagtgctaggattacaggcatgagccactgcgcctggcgatatttcttaataaattcatgtcttgctgagtgtggtggctcaagcctataatctcagcactttgggaggccaaggcaggaggatcgcttgaggtcaggaaatcaagaccagcctgggcaacataaaagaccctatgtctgttttaaaaaatttaaaaataaataaataaataaacttgtcttgacgctcgagaccagcctaggcaacatagccagtcccccatttctacaaaaaataagaaaattagccgggtgcaggggcacatgcctatagtgccagctacttgggaggcagaggtgggatgatcacttgagcccaggagtttgaggctgcagtgagctatgattgtaccacagcactccaggatgagtgacagggggacacccgtctctaaaagtaaataaatacataataaaatcctgtcttttttttttttttttgagatggagtcttgctctgttgcacaggctggagtgcaatggcgcgatgtcagctcactgcaacctccacctcccgggttcaagcgattctcctgggtcagcctcctgactagctgggattataggcgcgtgccaccgcacctggctaatttttgtatttttagtagagacagggttttgccatgttggccaggctggtctcaaactcctgacctcaaatgatctgcccacctcggcaggtgaggagagttgatgtgaatttcaggaacacagcccggggccagggccatagggggatgagtgttgggcctccagctcctcacacagagctatcctgccccaaaccacccagggcattttttgccaccagctcctgcctctggataatgtttttttttttttttttcagatggagtcttgctctgttgcccaggctggagtgcagtggtgtgatcttggctcactgtaacctccacctcccaggttcaagcaattctcctgcttcaggctcccgggtagctgggatgacaggcgggcaccaccatgaccagctaatttttgtatttttagtagagtcagggttttaccatgttggccaggctttgatccacccacctcagcctcccaaagtgctgggattacgggcatgagccaccgcgtccagcctgcctgtgggcattttgtctttctccctctgtccccactctcacatcccacctcacatgcacagaagctattccctccacccttcttctgtgcttattcttggaaaaagacacaacaaacccatgtacactcatgctggtgataagactgttacctgctccccagcaaagcctaagctgtggtcacagttacaaaggcctatggaaatccagatttttgtgcatacttttctgatttttgtctgttaaaaaccaaccagtgtgtgttaaaatattttgttcatgggcagcctctggcccacaagacaggggagaacgccatgtgacaacagaaggtgggagggacctgtcagaagccaaggaatgccaaacatggccagcaaaccaccagaagttaggctgagtcaaggaagggttttcctctgcaggcttcagagggaggacgaccctgccaacaccttgattttggactcctgagctccagaaccaggagacaatagacttctgtggctttcagccattcagttggtggtgttttgtcatggcagaccagcaaacaaacacagatttgatactttatgtcctctggccaaaggtcggactttaagaagtcacagggaggcagctttgtgtgccatcttggaggccaccagctggcaggatggctccattcacatggcccgtcttgcaagagggtcccagggcatttaggtcattgagtgagtgtgtgctcccaggagccagcagggcatctggcatcacaaagacatccagaagtgagtttgaattctgttttctcagatgccacagctctctttaaggactctggcccagactgtattggggactcacctgctgagccagaataaaagtgcagaaagtgcaccccaatcgctgcctcccctgagaagagaaagcccatggagagggtgctggctgggactctgcccggctgcacatggactcctgccttcagaattggcttggggcttttgataacaggatttcaaggagagtgtctgggtttatggaagtagggcctctagactgatagcggctgcttcttctttaaaaaaaaaatcctctctgagctagattctaacatcaagtcagcaggcagaaccattttaagaggacagggcatggtggctcacacctgtaatcccagcactttgggagcccgaggcaggtggatcacttgaggtcaggagttcgagaccagcctggccaacatggtgaaacccccgtctccactaaaactacaaaaattggctgggcatggtggcgtgtgcctgtaatcctagctacttgggaggctaaggcaggagaatcacttgaaccagggaggcagaggttgcagtgagcagagatcacgacgctgcactccagcctgggcgacagagcgaaactccgtctaaaaaaacaaaacaaaacaaacaaacaaaaaaaaaacaggacaggacagatctgctgagagctagggtcacaggatccagaacccgagcagggtctcaggttgcatggaatcaggaatcagcctgaattattcctcagagtggacacagaagaaacccaggtggaaaccaagtgtggatgtgtggctaaagagggagcaaggcagccccagccgagccgcgtgggcggatcccaggtgcaggcagagcggcagccgcaggactcagaggttaggtgggctctggaagtgggtgccaggcagggcaaggccccgtgcgcagtagagagtgtcagtcaaagcaagcgcactggggacttgtccctgtggggagttctcatgttgtggcccaagggtggagagttgggctaaagaagcaagctcaggccagattgggcacagtggctcacacttgtaatttcagtactttgggaggttgaggtgggaggatcacttgagtccaggcgttcaagagcagcctgggcaacagagcaagaccttgtttctagaagaaatttaaaaaataatgataattagccaggcatggtagtgtgcgcctgtagtcccagctactccagaggttgatgggaggatcgcttgagccaggagttagaggctgcagtgagccatgatcatgccactgaacttgagacttggcagcagagtgagatcatctctaaaaaataaaaataataaaaaataataagaaaataaagaagcaggctcaggccagagaacaagaggaatgggcctcttatctcctctgcatgactgaagagaattctgctcatgtctttcacaggcagagtggccgggtaaatagatacaggatgcccagggcactgagagcacgggtccacgcatccggttatcctgcatctggcctttgcccgtggagctttcagtcatggcctccggtaacatgcacattggaaagctcacccctgacttcaaggccactgccgtggtggatggcacctacagggaggtaaagctgttggactacagagggaagcacgtggtcctcttttccatcctctggacttcacttttttttttttttttttaaacagagtctagctctgttgtccaagctggggtgcagtggctcgatgtcagctaactgcaacctctgcctcgtgggttcaagcgattctcttgcctcagcctcccaagtagctgggactacaagcacatgccaccttgccctgctaattttgtatttttagtagagatgggatttcaccatgttggccaggtcagtcttgaactcctgacctcaggtgatttgccagcctcagcctcccaaagtgctgggattacaggtgtgagccactgagccttggacttcactttcgtgtgcccccacagagatcatcgcattcagcgaccatgctgagggcttccgaaagctgcaaagtgctggggacctcggtgggctcagttcacccacctggcttggatcaacatcccccggaaggagggaggctttgagtccctggacacccctctgcttgctgacgtgacctgaagttgtctgagaattacggcgtgttgaaaacagacgagggcattgtctgcaggggctttttttttttttttttgagacggagtggcccaggctggagtgcaatgatgcaatctcggctcactgcaaccttcgcctctccggttcaagtgattctcctgcctcagcttcccgagtacctgggattactggagtgcgcgaccacgcctggctaatttttgtatttttagtagagacggggtttcttcacgtcagtcaggctggtctcgaactcctgacctcaggtgatctgcctgcctcggcctcccaaagtgctgggattacatctgtgagccaccacgcctggcctgcagggacctctttatcatccatggcaaggatgtccttccccagatcgctgttaatgattggcctgtgggacactttgtggatgaggccctgcggctggtccaggccttccagtacacagacgagcacccggaaatttgtcctgctggctggaagcctggcagtgacatgatcaagcccagcgtgaatgacagcaaggaatatttctccaaacacaactaggctggctgatggatcatgagcttgtgcccctccatgagtgccctgtgttgacccaggaaaggccagatcttcctctctaaactgtacagcctgggaccctggagagctaggccaaggccttctcatgcttccaactgggagctggtgaatagtgacaccctccccaaaacccacccagctgcacacagacctggaaatgaccaataaagtattagggacagaaaataaataaatgaataaataaattaattaattaaatacaggacaaccagttaaatctgaatttcagataaacagtgaataatttataatgtaagtatgtgcaaatactccatgggaggcccgagcatgatgactcgcatctgtaatcccagcactttgggaggctgaggcagtgtttgagccaaggagttagagaccagcctgggcaacatagaaagaccttatatttgaaaacatttagaaattagccaggcatggtgttgtgcgcctgtaattctggctacgtgacaagctgaggcaggaggattgcttgagcccaggaggtcgaggctgcagtgagttgagattacaccactgcagtccaacctgggcaacagagtgaggccttgtctcaaaaaacaaaggcaaaacaaacaaacaaacaaacaaacaaaaaactcaatcaaaccaacaaaaaaacagacattgcatgggacatatttatatactaaaacaataaataattccaatgtatatcctaaaaattgcacaggacatccttatactaaaaaattcttcactacctgaaattctgatataactgggtatcctgcattttcatttgccaaatctggcagccatatcccaggcaacaaagaaagcacctcggccgggtgcagtggctcatgcctgcaatccgtctcaaaaaaaaaaaaaagtacctccttcagcatcacattttgcatcgacactcaataaatatccacatcaaggaggaaaaaaaagccaccgggctgcagagaagagcagggttattggaaccagcagaaacatggtaaattaaactcctcttcctgcctcaagcattgaaggtcatagtgacgacaactctctagaaactcaacccaaacagctccagaccaaacccgaggaagtcgcaggagttttcgacttctcttataattactacccgaaggcaccatattgaatgcagcttgggatgccagcagcgtggtttgggacgaggcccagtgcagtttttcccagagctattatagggaagtagtcatgaaacaagacggatgcgctatggttgagaactgcagagctgacccaaaatatttctaatgtgtggaactagctggcaagcggagagcctgagaaaacaaaaagagctgcttgactgctttgaaatgcccagatcctcgaagtgtggcttttccttcatgctattagctgtgttccaacaggcagagagccaagggaagaattccagtgggggccatcttggcaggcgcacagtttggccttgacagcttcatttgaagggcaagacagggtgagaaggagggagggcccgggggaatcgggaggccagaggacaagcccttacctctgtggggtgcctcagagggtcaccaacactcacaagccactcacttcttgcaaagactgcctgaaacaggtactgttttctccattttacagacggggaaagtgatgtttccaaagttatctagtggcttagaattcaaactcaacactttttttgttttgttttgttttgttgaggggggaggtcttgctatgttgcccaggctggactcaaactcctggcctcaagcaatcctccctcctcagcctcccaaagtgctgggattacaaatgtgagccaccactcccagcctcaaaccttttttattcatacttttttatatttataataaatatattatactttttaatttattttttgcataggtaatatattcacatggttcaaaacccaaaatatacttagggatatagtggaaatcctgtctccctgggccccagcctcctgcctctcctctgcagaagcccttgatgtttttcatttcttaagtaaccttccagagatttctttcttttcttttttttttgagacagagtcttgctctgtcacccaggctggagtgcagtgggcacaatctcagctcactgcaacctctgcctttcaggttcaagtgattttctggcctcagcctccctagaagctgggattacaggcgcccgacaccacgcccagctaattttttgtatttttattagtgacggggtttcaccatgttggccaatttggtcttgaactcctgacctcaggtgatctgcccatctcggcctcccaaagtgctgggattacaggcatgagccaccacgcctagcccagagagattttataaatacatatttttcagcttttctttttttagacagatgatatttactatacacactactctgctattctcacttaaatcaaggtctttcagtcttgatctagtgctccatcttttattattattattattattattattattattattattattattttagagacagggtctcactgtgttgcccaagctggagtgcagccatttctcttaccgtctcctgtctctgaagagcaggaggaagtaaaagttgaaaaacaatagcaatgaagtcagtggcaagaccagccggtgccactgatgacctggcctgaggttaaaagattaacgcccccccactctaaccacatgtgctctcaatccatcacgaccctttctttcacgtggacccccttagagttgtaagcccttaaaagggccaggaactctgtcttcggggagctgggctcttaagacgtgagtctgccaacgctcccagccgaataaaaacctcttccttcttcaatccggcgtctgaggagttttgtctgcagccagtcctgctacatttcttggttccctgaccaggaagcgaggtgattaagggacgggtcgaggcagccccttaggcctgccctgtggaacatccctgcaggggactctgaccagctcgagcgaggtggatcctgagagggctcccgggtaagcaattgccccggtggaacgcctcatcagagcagtgtgtggcaggcccccgcggaggatcaacgcagtggctgaacactgggaaggaatgggcacttggagtccggacatctgaaacttggtaagactggtctttggaacttgctcgctccatttgagtggaagcatggcctgatcacccacggtgtgcctgtaccggcactttggttcttgtttttgacttgacttgaattgcttgatactatggttttggttttgacctggcttggatttctggatactctgattttggttttgattctggcctggtgtaaactgaaaaagtgtgtgtgtgtcctttttacccattctttgttctgtggtgtgcgtgtggtatgagtgtggtgttttgtcttcaggaaacatgggtcagacaaaagtaagcccactccacaaggagctatgttgaaaaattccaaggaaggatttagtggagactatggggttactatgacaccagggaaacatagaacttcgtgtgaaatagattggccaacattagaagtgggttggccatcagaaggaagcctggacaggtcccttgtttctaaggtgtggcacaaggtaactggtaaaggatacctagaccagttcccatacatagacacttggttacagctggtgctagaccccccacagtgactaagagggcagacagcagcagtgctagtagcaaagggacagatagctaaggaaggatcccgctccacccgcccagggaaatcaacaccagaagttctgttcgacccatcatcagaagatccattgcaggagatggcaccagtgatcccagtggtgtcctccccttaccagggaaagaggctccccacagtagagcccacagtgcttgtgcctccgcaaaacaagcatatccgtaggccacccagagtagacaagagaggaggtgaagacttgggagaaacccctcccttagcagctcttttatgacccaaaactgggatacaaatgcccctgagagagcagcggtatactgggatagatgaagatggtcacatggtggagaggcgtgtttttgtgtgccagcccttcacctctgccgaccttctcaactggaaaaacccatcctatactgaaaagccacaagctctaattgatttgctccaaactattatccagacccacaaccccacctgggctgattgccaccagttgctcatgttcctctttaacacagatgaaaggtggagagtgctccaagcagcaactaagtggctagaggaacatgcaccagctgattaccaaaacccccaagggtatgtaaggaccccgttaccaggaaccaacccccagtgggacccaaatgaaagaaaggataagcaaaggctaaactgatacagggaagctctcttggaaggattaaagaggggagcccagaaggctacaaacgttactaaggtctctgaggtcattcagggaaaagaagaaagtccagcacaattctatgagagactgtgtgaggcctatcgtatgtatactccctttgatcctgatagccttaaaaatcagtgcatgattaacatggctttacttagtcaaagcgcagaaaacattagaagaaaactgcagaaacaggctgggtttgcagggatgaacacatcagttattagaaatagctaaccaggtgtttgtaaacagggatgcagtaagccataaggaaaaccgcaaagagaatgaatgtcaggcccggcgaaatgctgacctgttagctgcagcaatcagaggggtccccacaaagaggcaagggaaggggggtcctgggaaagaaactcagcttggctgtcagagtttgcagcgtaaccagtgtgcttattgtaaaaaaaaaaaaaaaaaaaaaaaaagacattggaagaacaaatgccctcagctaaaaagaaaacaaggtgactcagagcaggaggccccagacaaggaggaaggggccctgctcaacctggcagaagggttactggactgagggggaccgggctcaagtgcccccaaagagcctatggttagaatgatagtcgggggtaaagacattgattttcttttagatgccggttctgaacattcagtagtaaccgccccagtcacccccttatccaaaaagactattgacataatcagagccatgggggtttcagcaaagcaagctttctgctggccccggactcgtgctgtaggaggacataaagtgattcatcagtttttgtacatgcctgactgtcccttgcccttgttgggaagggacttgcttagcaagctgagagccactatctcttttacagagcatggctctttgctgctaacattacccagaacgggagtcattatgacccttacggttccccgagaggaggaacggagacttttcttaactgagccaagccaagagataagaccagctctggctaagcggtggccaagagtatgggcagaagacaaccctccagggttggcagtcaaccaagcccacgtacttgtagaagttaagcctggggcccagctggttaggcaaaaacagtacccggtccccagagaagctcttaaaggtatccaggtccatctcaagcacctaaaaacttttggaattatagttccttgtcattctccatggaacactcccctcctgcctgttcccaagccagggaccaaggactacaggctggtacaggatttgcgcttggttaatcaagctacagtgactttacatccaacagtatctaacccgtgcacattgttggggttgttgccagctgaggacaggtggttcacctgcttggacctgaaagacgctttctttagtatcagattagcccgtgagagccagaagctgtttgcctttcagtgggaagatctggagtcagttatcactactcaatacacttagacccggcttccccaagggttcaaggactcccccaccatctttggggaggcattggctcgagacctccaggaatttcccaccagacacctaggctgtgtattgctccagtacgttgatgaccttttgctgggacaccccacagcagttgggtgcgccaagggaatggatgccctactccggcacctggaggactgtgggtataaggtgtccaagaaaaaagctcagatctcccgacagcaggtacgttacttgggatttactatccgacagggggagcgcagcctggggtcagaaagaaagcaggttatttgcaatctactggagcctaagagcagaaggcagttgacagaattcttaggagctgtggggttttgtagactgtggatcccaaactttgcagtattagccaagcctttgaggtcacaaagagggaggaccgggaaatttttgaatgaggatcccaacaacagcaagcctttcatgagttaaaggaaaaacttacgtcagccccagccctggggctacccaatctgacaaagccttttacattgtatgtgtcagagagagagaaaagatggcagttggagttttaacccaaactgtggggtctaaaggatggcccatgtttgagggccttggcagcaactgccctgctagtgaagaagcaaataagctgactcttgggcaaaacctgaacataaaggccccccatgctgtgactttaatgaatactaaaggacatcattggctaatgaatgctagactcaccaagttccaaagtttgctctgtgaaaatccccatataaccgctgaagtttgtaacatcctgaaccccaccaccttgctcccggtatcagagagcactgtcgagcatgattgtgtagaagtgttagactcagtttactctagcagacctgacctccgggaccagccttgggcatcagtagactgggaactacacgtggacgggagcagcttcatcaacccacaaggagagagaggtgcagggtgtgcggtggtaaccctggacactgttgttgaagccagatcattgccctagggcacttcagcccagaaagctgaactcattgctttaattcgggccttagaactcagtgaaggtaagactgtaaacgtttacactgattctccgtatgcctttttaacccttcaagtgcatggaacatgatataaagaaaagggcctattgaactctgggggaaaagacataaaatatcaacaagaaatcttgcaattattagaagcagtatggaaaccccacaaggtgtcagttatgcattgcagaggacaccagcgagcttccaccttggtgggtttggggaattccctcgctgacccagaggctcgaaaagcagcaactgcccccttccgggcatcagtcacagcccctctgctccctcaagcacctgatcttgcacctacttattctaaagaaaaggactttctccaggaagatggaggacaagtgatgcaggaaggatggatttggttaccagatgggagagtagctgtgccacagctgttaggagctgcagttgtactggctgtgcataaaaccacccatctaggccaggagtcacttgaaaagttgttaggctggtatttctacatctcacatttgtcagcccctgccaaaatagtgacgcagcagtgtgttacctgctgacagcataatgcgaggcaaggtccagccattccacccggcatacaggcttatggagcagccccctttgaagatctccaggtagattccacagagatgccaaagtgtggaggtaacaagtatttactagttctcatgtgtgcctactctgggtgggtggaggcttatccaacatgaactgagaaagctcgtgaagtaacccgtgtgcttcttcgagatcttattcctagatttggactgcccttacggatcggctcagataacgggccggcatttgtggctgacttgatacagaagacagcaaaggtattggggatcacatggaaactgcatgccgcctaccagcctcagaattccggaaaggtggagtggatgaatcggactatcaaaaatagtttagggaaagtatgtcaggatacaggattaaaatggatataggctctccctatggtattatttaaaattagatgtaccccttctaaaagaacaggatattccccttataaaatattaggccccctcccatattgcggggacttccaggcactccccgagagttaggtgaaattgagttacagtgacagctacaggctctaggaaaaattgcacaaacaatctcagcctgggtaaatgagagatgccctgttagcttattctccccagtttaccctttctccccaggtgatcaagtatggattaaagactggaatgtagcttctttgtgcccatggtggataggaccccagattgtcatcctgaccactctcaccgctgtgaaggtagaaggaatcccagcctggatccaccacagccatgtaaaacctgcagcgcctgaaacctgggaggcaagaccaagcccggacaacccttgcagagtgaccttgaagatgatgacaagccctgctccagtcacacccagaagctgactagtccatgcacggccgaagcatgaggaagctcatcgtggaactcatttttcttaaattttggacttgtacagtaaggacttcaactgaccttcctcagactgaggtagggcaaaaagttaaaacagtctttctgtttaaaagggacttgtgtgtataatgccacccagtacaaggtatgcagctcaggaagtgaccagactcaagtgtgctacaacccagtagaactacttaatccccattggaaaacaagagagtatgtaactctaggagtcaatggaattggactggcaggaagacctaggtaatgtaggtggaagtgagaactcccactagtgagtgaggttctcaaaggggagaatgaggagggaagccatttctcttactgtctcctgtctctgaagaacaggaggaagtaaaagttgaaaaacaacaggaaggaagtcagtggcaagaccagccagtgccactgatgacctggcctgaggttaaaaggttaaccacccccctctcctctaaccacatgtgctctcaatccatcacgaccctttcatgtggaaccccttagagttgtaagcccttaaaagggccaggaactctgtcttcggggagctcggctcttaagatgcgagtctgccaacgctcccagccaaataaaaacctcttccttcttcaatccagtgtctgaggagttttgtctgtggcccgtcctgctacagcacaattgtagcccactgtaacctcgaattcctaggctcaagtgatcctcccacctcagcctcctgagtagagtagctaggattacaggcatgtgccaccatgccaagctaattttctttagagacaaggtcttgctatgttgcccagggtggtctcaaactcctgggctcttggcctctcaaaatgttggattttaggattataagcatgaaccactgtacccggactgctctttcttacaaaaaaaagtattttcccattagaaaatatagtgaatttgataaatacaaaaaaaggtggaaagacctctccctctccctctccctcctctccctctccatctccccactccctctctctccacggtctccctctgatgctgagccgaagctggactgtactgccgccatctcagctcactgcaacctccctgcctgattctcctgcctcagcctgccgagtgcctgggattgcaggcgcacaccgccacgcctgactggttttcgtatatttttggtggagacggggttttgctgtgttggccgggctggtctccagctcctaaccgtgagtgatctgccagccttggcctcccgagatgctgggattgcagacggcgtctcgttcacttagtgctcaatgttgcccaggctggagtgcagtggcgtgatctcggctcgctacaacctccacctcccagccgcctgccttggcctcccaaagtgccgagattgcagcctctgcctggccgccaccccctctgggaagtgaggagcgtctctgcctggccgcccatcgtctgggatgtgaggagcccctctgcccagctgcccagtctgggaagtgaggagcgcctcttcccggccgccatcccatctaggaagtgaggagcatctcggcctggccgcccatcgtctgagatgtggggagcgcctctgccccgccgccccgtctgggatgtgaggagcgcctctgcccggccgcgaccccgtctgggaggtgaggagcatctctgcccggccgcccggtctgagaagtgaggagcccctccgcccggcagccaccctgtctgggaagtgaggagcccctccgcccagcagctgccccatctgggaagtgaggatcgtctctgcccagcagccgccccgtctgggaggtgtacccaacagctcattgagaatgggccatgatgacgatggcggttttgtcaaatagaaaagggggaaatgtggggaaaagatacagaaatcagattgttgctgtgtctgtgtagaaagtagaagacatgggagactccattttgttctgtactaagaaaaattcttctgccttgggatggtgttaatctataaccttacccccaaccccatgctctctgaaacatgtgctgtgtccactcagggttaaatggattaagggaggtgcaagatgtgctttgttaaacaaatgcttgaaggcagcatactcattaagggtcatcaccactccctaatctcaagtacccagggacacaaacactgcggaaggccacagggtcctctgcctaggaaaaccagagacccttgttcacttgtttatctgctgaccttccctccactattgtcctatgaccctgccaaatccccctctgcgagaaacacccaagaatgatcaataaatactaaaaaaaaaaaaaaaaaaaggtggaaagaataaagtattgtcttttgtcctgccccgcaaagccaccactgttaaccatttgctgtttcacttcaggctttgtttgtaaatgattttgtatggactctttctgctataccacagtcacctcttggggcagaactagggacagaaagacaatggggccaggtgaggtggctcacacctgtaatctcaggaattttggaggctgaggcaggagaatcccttgagtttaggagttcaaggccaggccgggcaacatagtgaaaccctgtctctttaaaaaataaaaaaattaactgggcatggtggtggacacctgtaattctggggggctgaaatgggaggattgcttgaacccaggaggccaaggctgcagtgggtcatgatggtgccactgcactccagcctgggcaacagagtgagaccctgtctcagggagaaaaaaaaaaaatgggaagaagagaagaaagaaagaagcaaatatgtccagtgggtgtgggactgatgtgagccaggagaggttagctgagaaagtcggtgtttcatccatccttttgaggacctcttttttttttttttttttttttgagcccctagtacctgcattgtgaaaatatagatgctaagataaagccagggctgggtgtggtggcgcatgcctgtaatcccagctattcaggaggctgtcaagagaattgcttgaacctgggaggtggaggttgcagtgagccaagatcacgctccagcctgggtgacagagtgagactctgtctcaaaaaataaataaataaataagtaaaaaataaaaaactgagagcagagaaaaaatgaaggaactggccatttcaacactgcgacaggtgctaggacagacagtgagaaagcacagcgggctgaagaagccctacaaggaggtgggatcagagaggcccctgggggaacggcccagagctgagtcgtgatcagcaggtgatggctggaggggcattcctgcagaagggattgcagaagtagagatagtttagtgtagtggagctgggaagggccaggtgtgtaatgtacaaggaattttgacttgatcccgagggtaacgtgaagctcttgaaagttccaaggcaggaaattgacacgattggatttgcactctgacaatgaccaagtctggctgctgggggtaaaccattaggagtagaggaggcggaggggagtctggagattggagaatttgttacgggactgttgcatgtatcccagagagacaaggcagtggcgtgaactaaggttgtagggatggagggacatgggtggatttttaagaggctacagatatagaatcggtaactgaatggggatcagaatggctcacacatggaggcctgggcatttattgattcaagattcctcactggccctcctttacaaagatttaggcttctgggcttggcatggggatcctcaatggcatcacttcaaccttgctttgtcatctctctctctttcccttctctacttgtacttaaagtgcattggaatttggtgattccctgggcatgctgtcccttcatctcacgtccttctcctcatacctgggcttctgaaagcatctccatccttcaagcccagcccaatgccacatctctaaagaaagccttggggcgccagccctcccctccttcccactactcttttgtaacaaatcttctagcaagttgcgtctccacctgaggaaacactcaccacattctgcattgtacttcttgtggagaaaaaaaaaagtactttttatggctgattttttttttttttttttgagacagagtcatattttgttgcccaggctggagtgcagtagcgcgatcttggcccactgcaacctctgcctcccaggtccaggcaattctcttgcctcagcctcccgagtagctgggattacaggcacatgccaccacaccctgctgcatttttgtacttttagtagagatggggtttcaccatgttggccaggctggtctcaaactcctgacctcaggtgatccacccgcctcagcttcccaaagtgtcgggattacaggcatgagccatggcgcctggccagctgatttttactacaaagttaaagcctcctcaaaagctgacaccacacctgtcttggaagctcaaggaatgtttgtcaaattcaaatgagcactccccagaaaacccaaattctgagccaagaaggtttgtgaaataaaaaagaatcaggcgggcacaggggttcagctggggaaatagactaaaacagtgagaagaccctgaaggcaggaaggaccagcaagggtagggttggtgataaggccgtgaccttgggcataggatacaggttgatgccctggtttgaggccccggctgtgtgctgtggtccttaggattgtgagggcctccacccagaagcagagacctcagatgctgttagaccccgaatagcatggagggaagtgtgtggagtcaggccctaagccgctgggttagagtacagagggttttctgaaacagtgaaatcccgtcatctccttccagaatatgaaccatgcctcctcctctaaacttccctgaacgtgtctgtttgtttgtttttaagacacggtcttactttgtcacccaggctggagtgcattagtgcaatcttggctcactgcagccttgaactcctgggctcaagtgatcttcttgccttagcctcccaagtaactaggaccacaggtgtgtgccactacacctggctaaatttcttattttttgtggaggatggggtctcactatgttgcccaggctggtctcaaactcctgagctcaagccatcctcccatttcagcctcccaaagtgctgggtttacaggcgtgagccattgagcctggctccctgagccctcactatcaactttcaccacatgtagggccctgcagtgaccacaggccaggccgccactgtcaggagctcccatagcttagcctcaatgcaactctttctagctgagcatctctctttcaaaacagaggtggaggaagtgggtgaggagagacctgcattgagagggtgctctaaggacaatcctggcctgagtagaggtctgatgttctgagtgtcaccttatgagccatcagaaactaaggtaaacctttgttcttcccagattgtaccttctgaacagagaaatgaaggaccaattaagagaagttccacaagatgcattctagataagaaatctagggccaggcacagtggctcatgactgtaaacccagctgtttgggaggccaaggcaggaggatcgcttggggccaggagtttgagaccagcctgggcaacattgcctgactcctgtctctacaaaaaaatattttaaaaattagcccagtgtggtagtgtgcacctgtggtcccagctactcaagaggctgaggcaggaggatcgcttgaccccaggagtttgaggctgcagtaagctatgatcactacactccaacctgggtgacaaagtgtgagaccctatctctaaaaaaatcaaaaaattagaaaaaaaaatttttttttttttgagatggagtcttgctctgttgcccaggcttgagtgcaatggtgcgatctcagctcactgcagcctctgcctcccggggtcaagcaattctcctgcctcagcccctgagtagctgggattacagacacatgccaccacacccagctaatttttgtatttttagtagagataaggtttccatgttggccaggctggtctcgaactcctgacctcaaatgatcccccaccttggcctcccaaagtgctgggattataggcgtgggccactatgcccagcaaaaattttaaataatgcttcctagcactctgggtattatatcacagaggccagaggcagtaactgggagaatgtgggattctggagtagagatgggaatgatgggaacagaggaaagagtaagaccatggtaaagtgtcccaaaccctgcatgcctcagacaacagcggtctctgagccccatccttgtggccaggcacagctcaggtcagcaggaacaaacagtaagtaaataactgctaagataaggaaccctgggagaagagggggcacccatcaagagggcgagttgaagatacaggaatgggaaggaatccagagcatgagagatgggaaaatgaatccccctcctattccaagaaagaggaggtggtgtgaaccaggcagaagctggtaggactgcaggtttgggggctggaaacagaggcatctccaaataagtgcttctccatgcggcgtgttcacttttctctagttcacatgaggctcctcctgtggctttggttgttactggagcccattcacccacattgctgcacgtagctggagtttatcttcattgcttccgatgaatacaattttcattgcaccacttatccattctgctgttgatggacatttgagttccttccagtcctgggatatatcaaataatgctgctatgtatattcttttttgtgtgtgtgtgtgttcttaaatttatctttattaattttttttctttagaaatggggttttgctctatctacaggtaagtgccatgatactcagctaatttttaaaatttttgtagagatcggggtctcactatgttgcccacttcttttcattgctatgagcatattttgggggggtgtatatctaggagtagaactgctgagtcatagggtatgcacattttcaactttagaagacagtgccacactgtttcctaaagagactgttccaactaactcccaccagtaatgcatgaaattttcagttgcttcactcctcaaatagcccgtttttaaaattctaaccattctggtgagtgggtaatggtatttcattgtgatttaaatttttatttccctaattactaatgaagttgagcatcatttcatatgtttattgaccatctggatttctgcttttataaaattcagtctcttcccaaattttcaattgggttatctgtctttttcttaatgatttgtagcaattctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagtcaccgcgcccggcctgtagcaattctttcaatattctcagtataatccttttgtcagttacacctgttgtatcttttcccagtctgtggctggctggccttatttattttgctcatagtgtcttttcatgagaactctttaatgtaggcaaatgtattgatcttttttaaaaaaaatagcattaatgcaagatcatgaaattctatatcaccctctaaaagctttatttttctgcctatcatatttttttctacagcctctctaggattgacttttatgcatggtgttaggtgggggacaaatttcgggttttttttttccttatggatgtccagttattccaggatcatttattttaaagtacatcttttccccacttctttgcagtgacacctctgtgaagaatcaatgtccagccaggcacggtggctcatgcctgtaatcccagcactttgggaggccgaggtgggcggatcatgaggtcaggagttcgagaccagcctggccaacatggtgaaaccccgtctctactaaagatacaaataattagctgggcatggtggcacacacctgtagtcccagctacttgggaggctgaggcacaagaatcgcttgaacccggaaggtggaggttgcagtgagccaagactgcaccactgcattccagcctgggcgacagggcgaggctctgtctcaaaaaaaaaaaaggatcaatgtccatgcatttaaggatctgtgtctgtgccctctattctgttctattgctgattgttagaccatcatagcattggcttattattgtacaattttataagtcttgatgcttagaagagtctttccatcttgctttacttcaaagagggatcttcttttctttcttttttttttttttttgagatggagtttcactcttgtcacccagcaggcgggagtgcagtggcaagatctcggctcactgcaacctccgcctcccaagttcaagcgatccttttgcttcagcctcctgagtagctgggattacggatgcccgccaccacacccagctaattttttgtatttttagtagagacaggctttcaatatgttggctgggctagtctccaactcctgacctcaggtgatccaccagccttggcctcccaaaatattgtgattacaggcatgaaccaccatacctagccctctttttttttttttttttttctttattgagacagggtctcactctgtcacccaggctggatcacagtgtgcaaccatagctcattgcacccttgaattcttgggctcaagaatcctcctgcctcagcctcctgagtagctaggactacaggcatgtgccaccatgcccagctaactttaaaaaaatattttggccaggtgcagtggctctggcctgtaatcccagcactttgggaggctgaggcaggtggatcacgaggtcaggagatcaagaccatcctggacaacatggtgaaaccccatctctactaaaaatacaaaaattagctgggcgcagcagcacatgcctatagtcccagctactcgggaggctgaggcaggagaattgcttgaacccgggaggcagaggctgcagtgatctgagatcatgccactgccctccagcctgagcgacagagtgagactccatctcaaaaaaaaaaaaaaatcagattgtcaaaaaaaatctcttaagatagaataacactgcatctatacatcaatttagggatacctatatctttacaatagtgagtctttcaattcataagcatggtatatctctctccatttatttagctgtttttagtttcttgaaaagctattttacagttctctatatagggatcttactcatgttttataaggttaatttttaggtactttgtatttttcatatcactataaggggtatcctatttcaaatcatttaaccagcatttgtaactaaacttttgtatactgactttgtattcagcaacttactaattttaataagttctctataaatcttaaaagattttctaagtatataatagcattgtattcaaataacagttggtctgttctttgcaattgttgtgcctctgatttccttttcttgatttatgacactggccaagaaatgttgaatagccatggtgacagcgggtatccttatcttgtttctgacattaaagagaaagctttcaactctttgccattaagtctttggtattcccagagatttactaggtctggctgtggatttcttttttatttatcctgtttggatttgggaattttcggtcttctgaaaactgtggctttatgtcttttgttagttttggaaagtgttcagctaaaactcctcaaatattgcttctgctcccttttctcctttatttgtggaactccaattaaatccatttagaccagcactaatacaacctgctgaatctgtgtccatgctggggctattaagcatttgtgttatatactggtatgtgactattaagcatttgaaatgtggttagtgcagttgagaaactgaatttttacattttatttaactgcaattaatttaaatttaaataaccacatatggctagtggctaccctattaaacagtgcagatttagaaccttccaactctgccataaatgtctcttgatctctcctgtgtatgttctgtccttcccatctatcttccagtgcccttattctctcttcagttgtgtctaatctactgttaaacacttctattgtgttctgaattttatctattttatttttcacttctaaaatttcttctaatttcttgtgctggttatcaatgtattgcctcttgcctccaaattcttccttttaggccaggcattgtagctcacgcgagtaatccagcacttgagaggccaatgcaggcagatcacctgagctcaggagttcgagaccagcctggctaacatggtgaaaccccgtctttactaaaaatacaaaaattaactggacatggtggtgggcacctgtagttccagctacttgtgaggctgaggcaggagaatcacctgaacccaggaggcagaggttgcagtgagccgagatcgtgccattgcactccagcctgggcaagaagagtgaaactccatctcaaaaacaaaacaaaacaaactcacccctttcgatactctgtgaaagtggatcttgtcctttaagtatttttttcccatgctagcagacaccaaggctttctaagtacagaatgatggacagacactgcaggtgaaggtcccagtgtacagggctgggcaggctcttgcagagtgcatagcttttctcgtgcaggcttctgcagtgagtgcagcttcctcagcacccagctccagcaatggacccagtactccctcccctggcacttttgtagtagagcatctcatctctagtgatgtcctttcctgtggacagctttccccagcaccctaaagggcagtgtattagtctgttttcacactgctgataaagacatacttgagaccgggcaatttacaaaagaaagagatttaatggacttacagttccatgtggctggggaggccttacaataacggcagaaggcaaaaggcacgtctcacgtggcggcagacaatagaagagggcttatgcaggggaactcctctttttaaaaccatcatatctcgtaagacttattcactgtcacaagaacaccatgggaaaagacctgcctccatgattccattacctcccactgggtccctcccacaacatgtgggaattcaagatgagatttgggtggggacacagccaaatcatatcaggcagatttccagcagttccaccagtgcagcagctcagcaacttctctgccttccagtgagccagagctgtccatggcctctcaacagggtcagaatctgagccctgggcgtgggctaaggtgctcaatctcagccctggagttagcgactgctcttcaaatctgccagctctatattttttttagaggcatttacttcatactagtcaatcccttgctactctaatgatttggtttttttgttgttgttttttttttggagatggagtttcgatcttgttatctaggctgcagtgcagtggcacaatctcggctcactgcaacctccacctcctgggttcaaacaattctcctgcctcagactcccgagtagctgggattacaggtgcccaccaccacgccctgctaattttttgtatttttagtaaagacggggtttcaccacgttggccaggctagccaggctggtcttgaactcctgacctcaggtgatccacccacctcagcctcccaaagtgctgggattacagacgtgagccactgcacccagctctaatccttttctaatcctttgttatagtaattttttttttctttagacaaggtctctctctgtcacccaggcttgagtgcagtggtatgatcatggctcactacagccttgaccgggctcaatcaatccactcacctcagcctcctgagtagctgggatgacagccatacatcacctgacctggctaatttttgtatttttttgtggagatgaggagttgccatgtttctcagggtggtcacaaactcctcagctcaagcgctcctcctgcattggccttccaaagtgctggaattacaggtgtgagccaccgtgcctggccaataattatttatattaagtatccctgtttaaattacaatgtgttttctctcttgtatttggacctaggcagatataatattttttttcaaatatgcaatgtcacttttttcttccccctgaaacagggtctcactctgtcccccaggctggagtgcagttatagctcactgcagcctcaaatttctgggttcaagtgagcctcccaccttagcctctcaaaatgctgggataacaggagtgagtcactatgctcagctaattttaaaaacattttttgacctggcgtggtggctcgtgcctgtaatccgagcactttgggaggccgaggcgggcagattacttaaggtcaggagttcgagaccagtctggtcgacatggtgaaaccccatcactactaaaaatacaaaaattagccaggcatggtggtgtgaccctgtaatcccagctacttggggtactgagacacaagaattgattgaacctggaaggtgaaggttgcagtgagccaagatcacgccattgcattccagcctgaatgatgagactctgtctcaaaaaaaaaaaaaaaaaaaaaaaaaaaaaaacaatttctgcagagacagagtctcactatgttgctgaggctggccttgaacacctgggttgaagtgattctcctgttttagcctccaaaattgctgggattataggcctgagccactgtgcccagcccagtgtaactttttatagttatagttccttcctgaaaatgttggtttccagctccatgacataataggcatagtgagtttacagtttgtaactagtagttgcactatcaggagtagctgtgagtctgtccctactgtctgctgatactgattctcattatttggtcttgtttcctcaagcagtaaattggatctgattttgtgttggtcattacagtttttttttgtttgtttgtttgtttttttttgagacagagctttgctctgtagcccaggctggagtgtagtggcgtgatctcggctcactgaaacctccatctcccgggtcccagctcaagcgattctcctgcctcagcctcctgagtagctgggattacaggcacgtaccaccatgcccagcgaatttttgtattttagtagaaacagggttttacaatgttggccaggctggtctccaactcctggcctcaagtgatccacccacctcagcctcgcaaagtgctgggattacaggcatgagccaccacacctggctaattctctatttaatcctatctagacagcgagttacttgagggcaagtaactctttgtatccgtggtgtctatcatggtgccttgcacctaggagacatccaataactgctatgtgaatgaaggaatggttaagaaaggatttattctgatttcttaaattttgacatttcctccaaaaaggtgatcttatctttgggagcaagagttcaatctgtttttcaaggactgaatcttaaggattgaacctacagagcctgctcaggcttgccgtagatgcttttcttctgctttctcatagagctaatctctgcttcacagagagcttttctttccaggtattcatgtttcaacaagtcaggaagcaaatgatttgacgttaatttggtgtcaaaaagaagtcagcccaggatcccaaaaataggttttaaaaaatcaatgcatggagatcaatttactttaaaatactgtaactttctttaagatactttggcaaggataatgtgatgtatgtaggcatgcctgcatatgtgtgtgtgtgtatgttcatttaagatacacttcagggaagtcaatgtctttaatcaggaacttgctcttcaagagtggtcagctaacatttcaccttaaggctgcacagcagagtcagctaccacaaaggcttcactgtacatacgttgatcaataggagtggggttttagcagcaaaatgaatgtcataaatcggtttcatttgtaaaattagtggcttgctaaacagtatgatgaatgtcagaaatgggctcctttcctacaaagaaaacaccaagcccagttagtttcacaggcaagtcaacttttttgaaaaatgtcattctaattttatagattttcctagagagtagagaaaaaaagattacttcccaactcatttcatgaggcccatataaattccattaaaataattagtatcctttaaaatcaggaagaagaccaagatcaccatgtctattccatatatttcggccaatacaaggaaaacaaattcaagtcaaaggcctgaaagggaggaaataaaactgtaattattttgtgattgtatgaatcctctcctagaagactgaatatataaaggagagagtttagcaagatgataaacagaagatccacatataatatgcgacaatgcattctattcaccagcaacagtattacttctttactatttatttcatttattttacactggcatttcctctctttaatgttgttttttgtttttttgtttttttgctgatgtgatcacatcctcctttattttacctttcctacttgttattttggtgagtggccagcaagttgctttccagctggaaagatggatggtgagggaccacttagtgatgctgaggaactgaccctgactcccgctctcactccaaagatgtggccttcctggctctaaaattgactcaagaaatgcagacccccaaaattagattttaaatgttctcaccacaaagatctgggcatggtggctcatgcctgtaatcccagcactttgggaggccaaggcaggcagatcacttgaggtcaggagttcaagaccagcctgggtaatataatgaaaccctgtctctactaaaaatacaaaaattagccgggtgtggtggcacatgcctgtaatcccagctactcgggaagctgaggtggaaggatcgcttgaacctgggaggcagaggttgcagtgagtctacatagcgccactgcactccagcctgggcggagagcgagatctgtctcagaaaaaaaaacgttctcaccacaaaggaatgacagtatgtgaggtgatagatatgttcattagcttgatttaatcagtccacatcatcaacatgtatcaaatcacattgtactccacgaatacatacaattattacttgtcaattaaaattaaaattaggggcccagcatggtggctcacacctgtaatcccagcactttgggaggctgaggtgggcagatcacgaggtcaggagatcaagaccctcctggctaacacggtgaaaccccgtctctactaaaatacaaaaattagtcgggcatggaggcgggcacctgtagtcccagctactcaggaggctaaggcaggagaatcacttgaacccgggaggcggaggttgcagtgagccaaaatcgtgccactgcacttcagcctgggcaacagagcaaaactccatctcaaaaaaaaaaaaaaaaaattaaaaattaaataaaataagattaggtcaggttctatggctcctgtctgtaatcccagtgctttggttggttggttggttggttggttggttggttggttggttgatttatttgtttatttatttatttatttatttattttcgagacagagttttcctcttgtcgcccaggctggagtccaatggtgggatcttggctcactgcaacttctgcctcctgggttcaagtaattctcctgcctcagcctcccgagtagctgggattacaggcaagtgctactacaccctgctaattttgtatttttagtagagacagggtgacagggtttcaccatgttggccaggctggtcttgaactcctgacctcaggtgatctgcctgtctcagcctcccaaagtgctgggattacaggtatgagctaccgaacctggcctataatcccagggctttaggaagcccaggcagaaaaaatacttgaggccaggagttgaaaaccagcctgggcaacatagcaagaccccatctttacaaaaaattttataattggccaagtatggtggcacatgcctgtggtcccagctactcagaggttcaggcaggaggactgtttgagcccaggagtttgaggctgcagtgaactatgatcatgccactgcactccagcctgggtgacagagggagaccctgtctctaaaaaaaaatgaaataaaaacaaattaaaatttaaagaccctcataactagttagatggtacatttaaacctaaatagattaatacttttattaaacattaatgtcataaatactccaataaaaagacagattgtcacacacatatacacacacacatacaaacacacacacacacacacaaacaagcagctcctcatgtttgtatccattcattacatggaagtattaaggtcatttatataaatttttcctgaacagaatgcaagttctaaaaaataaaggtctgttaaacaccctagaattaaacctctcaaatcaggcaagattctatcagcaccaaaaaacacatattttttagtcctgcatgatatctttaatttattaagctgtgtccttggctaaagaaatcaagaatttccagtgtatggatgtggaaattggaagtggggatggagcaaggaatgggtgtgtcattctgtcattccttaacagacctgaaaaatgcaaagttcttatgtaattttccatatcagtaatgattccattctatactggatacacataaacaaatatttctctaccattacctgtgaaaagaaaaaagcacagtatgaaatatttctgttcaccaagacactccattacttggcctgtaagataatatcttaagaatgctgtaactatccttctgctcccttacccagtattgcaacacacacacacacacacacacacacacacacacacacacacactcattactcatcacggcaatcttgtggtcttctttctgattacttatcatttgattagagttcttctggaatattttcatcaaacagaagtaggtataggatttattttctaaatcttgtgtaattttgaatatatttcttttaccttaacagttatataggctgagcgcagtagctcacgcctgtaatcccagcactgagggaggctgaggcaggcagatcactttaggtcaggagttcaagactagcctggccaaagtgctgggattacaggcatgagccaccgcgcccagctcaccaggatattccttaagtgttttattaatccagattggaatttggtgaattctttcacttcgaatactcaatttctttttagtacgtatgatttattattattattattggtttggtttaattacagcttctcttctacttttctttttaaaaaacctttctaggcattttattgtttacatgtaagattgtctgaatccagacttcaaatactttgtcagtttcttcaatatttccatctgcttgtaattttgttttatgttttgagatttttctctcactgaatctcctgggccactaatttagcctgcaactatcctcttcttcagtcatcaactgaaatttaaaatgaaaaactcgtgtttcttatttctttttctttttcttttttttgagacagtctcgctctgtcgcccaggctggagtgcagtggcacgatctcggctcactgcaacctccgcctcctgggttcaagtgattctcccgcctcagcctcctgagtagctgggactacaggcacgtgccaccacgcccggctaattttttgtacttttagtagaaatggggtttcaccatgttggccaggatggtctcgatctcctcacctcatgatctgcccacctgggcctcccaaagtgctgggattacaggcatgacctaccgagccgggccttgtttcttatttccacaaagtattttatgctgtaatagaatctcttctattttggctgggcacagtggctcacaactgtaatcccagcactttgggaggctgagggaggtggatcacttgaggtcaggagttcgagaccagcctggccaacatggtgaaatcatctctactaaaaatacaaaaattagctgggcgtgatggcaagtgcctgtagtctcggctactagggaggctgaggtgggagaattgcttgaacccgggaggaggaggttgcagtgagccaagatcgcaccactgcactccaggcctgggcaacagagtgagattccatctcaaaaaaaaaaaaaaaaaaaaagaatctcttctattttattttatttaagtatataaatttaaggggtacaagtgcagttttgttacatggatatatcttgtagtggggaaatctaggtttttagtgtaaccatcacccaagtattcaattttaccttcttgttcctttttggtccaagttattgaatgccttcatagattcctgcttttccttgggccggttccttttagatgggccagttcccttccttagctcactcatgagtctatttatcattggggtccagacccagctaacaggatacttttgcaatctctcaagtagtacaaggtctaggattggcttcctctatggtaggtgacatgccagctggcaggttgaaaggggatctgggaagctttactgtccctgctgtcctcaatggcaaaagctagatctgtgcagcctcaggcctgtgggacaccatcttttcacccttgaagctctctccttaggagatcagcagtgcatagattttctccagcccagctctccagagaaagggagctctggtcattgctctgggcttcttactgctggtcccacccccagcctgcttcagtcattcctgttggttgaacaggaggcaccaagcttcacctgcctgatggccacagctttagctgcactcaggaaggggagttaagctggtggttgaaatagatgtaggaagagaaacttgccattgtgtctcattggtttagggatgcagaaccatggcaacttccatgaaaggctgcagagagaaaatgagaaatatttagagcagtaattttttattgctgcctgtagagtctgaatcaatgggaaggcaaatattatttatcaaacacttaaaatagtatgtcaggcatggcgctaggaacttcagataagttatctcatacaatcttcacaacactatagtttttgttcgttaagagatggaaggagcttgctcggggtcaccttggcaagctattcaatggactagaatgattcatcttccaaatgtctacagttccccattgagctggagagagagggcagcctccctaacgagccagctctacagcttcagctcccaaagcttgcagagtaccagttgccatgacaacaggacaaaatgcagagaccctagctgctgggaggaaatgacatgagccaaaagagtaaaaactcaccccggtactggaatgtatgagtcacttacaaagaacacctgtaattttgagagcttaaaccaccagagggagacagagattgccacaggcgggggaatctgtctgtattccaaatgctgctgcctcccagcgctcccgccttttccccacactaagggcctctgcccagtctcccaggctgacccttcctctttcagagctcctcaaactatctcctcccaactggagctcaggacttgggacctggccccttgagggtgacagaaaggtgacttgcatcttctgggggaaaaagcagaggcattcagaaacgagagcccttccagaaaaccagtttgcacaatgaccaggaactctgacaccttaagcccatgcgaatcttgaatagagaaatcttggacactgaggtaagggtggtgctcggaaagtgtcttggtccagatttttccagaccctttgattcacagtggcatagatgctggcaacctgcttgctaatcgcccaagcgattccagcctggtgtcagggaggaagatgccctccgtcctctttcatctggaaaaagcagggtagcatgtgttaactcttacatatcaaattcctctaggaattctggggattccttttatttggctcagagaggaaacacctagaacatttatactctaacccagagaactgaggtggtttcctgggtatttctgatgtgcattaagaaagaagctatttcatttaagccaaaacataagtgggggctggattcaaaagcagactctccccttaaaacagcttcttcctttgcttctagtcattagggacaagtcatgagcctcttaagcagtaagcatgtgaacaatttgtctggttctaacaagtggtccttccagcaggacttcagggagcagaagtgtatgcactgctgcagaaaatgagttagaaactatcacaaaggaggaatgttgggcttgcagggaaaaaattatgaataattaccatatagcaggggaattacatgtctttcctgctgctcgagaactagactagaaccaaagggtggtcctgggcatgaggcatgaggagaactaggtagggaaaaggtctgtggagaagtagtagaaccagagaatggaaacaaacaaacaaacaaacaatgcagatagagtctgattctagccagggcttctaggcagctcaaagcctagtgtcagaggatgtaataaactcagcaccatttggggcaatcactgggaccaggcactccactccagcaggcagggcaagggatgctaggaagctttccaaagatcgttcctcaaaggaccgtcacagctggtggtggggaatgtggagggcagaaggcaaaaaagagaatgcatggtaccagcattccatcaccaggacaaggcccccagtattggcaggaagctaggtcactgaacagaaactaaggggctaggttcagtggctcaaacctgtggttaaaaaaaaaaaattaaaatttgactttagtcaaattaaatttaaaggtgtttaattgagcaaagaatgactggcaaattgggccatctcctgagccagagtaggctcagagactccagcgcagccacgtggtagaagatttaagggcagaaaaaggaaggtgacatacagaaaatggaagagaggtgcaaaaacagctggattggttatagcttggcatttgccttattagaatatggttggaacagttgaccacatttgattggccaaaacttggtgattggcacaagagtaggctacagtctgtttacaatttcctttagcttatagtccacaatgtacagagaaacctttaggtagaacttaaaatatgtaaggaggtagctttaggctaaatttgatttaatacttataatcccagcatgttaggaagctgaggcatgaggatctcttgagaccaggagttcgagacctgcctgggcaacatgaggagaccccatctctataaaaaaattagccagggcctagtggtgtgtgcctgtagtcccagctactcgggaggctgaggtgggaggattgtttgagcccaggagcctgaggctgcagtgagctatgatggtaccactgtactccagcctgggagacagagcgagaccttgtctgtaaaaaaagaagaaagaaaaaggaactgagggagtagactcttggttaaagcccagctggtcgactcagccaataaaacaggaggattaggcaagaaggagaagcatgaggaacactgtggcttgaggttgcttcacacggcccaggatgcacgaggcctgtggtgtcctgctgtgagagctgtggcagagcacgtggcattctggaatctctgaacttctcacagtaacgtttttcaatgcttgaaataaaatacccaggattataaaggaaaccaacaacactgaaagatttttgtcaaaatagtattagaaaacacatttttgaggccaggcgccgtggctcacacctgtaatcccagccctttggcaggccaaggaaggcagatcacctgaggtcaggagttcaagaccagcctggccaacatggtgaaactccatctctactaaaagtacaaaaattagccaggtgtggtggcacacacctgcagccctagctattcaggaggctgaggcaggagaatcgcttgaacctgggaggtggagattacagtgagctgagatcgcaccactgccctccatcctgggcgacagagtgagactgtctcaaaaaaaagaaaaaagaaaagaaaaagaaaaaagtttgacatagggatatgtagcaacaacagatattcctgtgttaaagtacctaggggctggtgagaggtgtggcagaacacatgggtctggggaatggagtgcaacgtgcggagctggggaagaccaggaaagacagagggagggaccacaacgcagagtccactgaagaggcaagtttgggaggtgataatgacttaaataccagaaaagttcctacagaggtcagagaacttgctgtcaggctgctgggaagcaggtttttcggtgtgcgaaaggttaaacctttaagactcaagtcaacctccatcctcctggagcccaggagacacaagacccaggaagtaccatctgtaggtcctcactagagtcatccaactgtcttccatgctttttgtttgggagccgaatgcttcagaagcaggatcctgtggcatttcttgtttgaatggtggcaagtcagcttgactgccagctcagcttcccagtctccccaggctgggacctgctgacctcccttgcaggcattgctccattctagtctctgggtccattccctgctttggggtaagaggcccatagcccagccctgctcattcaggcttgtttagtacccatcgatgatgcatgaatttcctcctgctttggagaccttcaggccccagttgggtgaactagacatctgccttgcttcctccacttggatctctgtcatggaaacctgcctggtgcctcagttcctccagccctgggcctggcttgcccattccgggctcagtagctggggctctggtaaccatggacttccttcctgatggcaccttctgcttgtccaccctgctgaacatctcttgcctctagtcatcctgatatactgatctggcagcctactgctttacacacatctgctattctgctggcctaccatcattgtctctggcgggacctgtctgccaggtgctgaatatgttctgaaaggagagctggccaggcatgatggctcatgccagtaatcccagcactctggggaggccaagctgagaggatcgcttgagtctgggaggccgagaccagcctgggcaacatagcctcttgaaaaaataagaaaatgaaagtagagccaacaggacttcaagatgaattacatgtagattgtgaaagacatgagtaaagggccgggcgcagtggctcacgcctgtaatcccagcactttgggaggccacggcaggcggatcatctgaggtcaggagctccagaccagtctggccaacatggtgaaaccccatctctactaaaaatacaaaaattagccgggtgcagtggcgtgtgcctatagtcccagctacttgggaagctcaggcaggataacagttgaacccgaagatgccttgcactccagcctgggtgacagagagagactccgtccaaaaaaagaaaaagacctgagtaaagaaaaactccaagggttttggcctgagaaactggaaggaaggagttgccatcaaccgagatgggcaaggctggaggaagattgtcttgactagctcagattactataacaaaataccttaggttgcataatttataaacaacagaaatttatttcttacagttctagaggctgggaagtctaagatcaaggcagcagccaattctgtgtctggtgagggctcacttgctctgcttcatagataagggtgccttctcacccttattccctatagctgcagggctgagattgctgaaaatcaaacacagaatttcaccctgtgtctggctgaatatcattgcaagttgtactcctggccttgcagagtgcccactattaaattgagagcattgattgagaaagaatggcaccttgtcagttgaggtggggatgtgtgtcaagatcctgacaaagcaggggacactgagcccctaaattctgatgagtctttttgccagtggaagaggtctctacacccctattggtatcaacctctctcttcacagtggtatcagcctttccacgcaggcaggactcgcaggtccaggaatcaaggggtgaaagtgagagcgtcactgttcactattatccctggtaacccattagcaaaatcttgcttcctggccccgtgaccttatgctctggtgacctagaggtcttagttccagagggaggaatgcttcaaccaggaaacacagcaatgatttcattgaactggaagttaagagtgtccccagccactttgagctcctcatggctctgaatcaacaggcaaagaagggagttcctgtgatggctggggtgaccgatcctgaataccaggaggaaattggacaactactccagagtgatgatcaggaagagtatatctggaatacaggagatcccttaagatcccttggtaccacctatgattagggtcaatggaaaactacaacaacccaattcaggcaggactattaatggcctagactcttcagaaataaaggtttgggtcacctcaccagatgaagagctacaaccagctgcaaagggaatatatagtgggtagtagaaacaaggtggttacaaatatcagctatggtcatgtgaccagttataaaaacaaggactgtaattatcctatttcctcctcatcttgttatgaatgtttgtgtttctatttttcatctcttattcccttatcatataacataagatatacggactttatatcatagtatttattaattttacaccacagtatttaagttatggactatcaaaagaagaataaacatcactgaaggattttacctcctcttttggggaagggattggtgcattttcagttgcatataggatagttagttgtatcatgttaggtggatctatgaccttgttattgacttttttgtttgtttgttttgaggagtctcactctgtcacccaggctggagtacagtggcatgatctcggttcattgcaacctccacctcccgagttcaagcaattctcctgcctcagcctcctgagtagctgggattacaggcgtgtgccaccacacctggctaattttttgtatttttagtagagacagggtgtcaccatgttggtcaagctggtctcaaactcctgacctcaaatgatccgccctccttggcctcccaaagtgctgggattacaggcatgagccactatgtccagcctgttactgttttcatttggagattaaatatgttttacagggaggcatgtgggtgcgaagttgacaagaggtggacttgtgatggctaattttacatgtcaactttactggccagccctcaggatgcctagatatctgcttaaacattatttctgcgtgtgtctgtgaggaggttctggaaaagattagcatttgaatcagtggactgagtaaagtagattgtcctctccaatatgggtaggcataattcaaccctttgagggcccaagtagaagaaaaaggtgaaagaaggttgaattctgtctctttacttgagtgcttgagctgagacatcagcctccttatcgtggaatgtgagttatgccattagcactcctccttctcaggccttcagacttagactggaattcatgccattggttttcctgggtctctagctagcagacagcagattgtgggattggtcaaccaccaatatcttgtgaatcaattccttataataaatctcattttgggctgggcacggtggctcacgcctataatcccttcactttgggaggccaaggtgggcggatcacttgaggtcaggagttcgagaccagcctggccaacatggtgaaacctcatctctattagaaatacaaaaaattagccaggtgtggtggagcatacctgtaaacccaaccactctggaggctgaggctgaggcaggagaatcacttgaaccctggaggtggaggccgcagtgagctgagattgcgccactgcactccagtctgggccacaagagtgaaactccgtctcaaaaataaataaataaataaaaataaataaatttcattttacatatacagtcagccctctgtattcatgggttccacattcatggattcaaccaaccacagataaaaaaacatttgaaaaaaagaaagaaaagaatagttgcatctatactgaacatgtacagacttttttcttataatttcctaagtgacacagtataacaactacttacatagcctttacctggtgttagaggttataagtaatctagagatgatttaaagcatacagaaaaatgtgcataggttctatgcaaatactacatcattttgtataagggacttgagcatctgtggatttttgtatctgtgaggggtcctggaagcaatcccccatgtatactgagagacaactgtgtgtgtgcatgtgtgtgtgtatttatttatgcatatgtgtgtgtgtgtatatatatatatatttatatctcctgtgggttctgtttctctggaaaactcgaatacacagggtattagatgattttcataaaaatgaacattcacacccactgcaaataccctaattttgagttcacattgcacttcacattacacttgtatttttcaagtgtattttttggaaaccatagcactataatactgtgttctgctgcatcccaggagattcctcggttggccacatacttgcccttttatagatagtccctggtgggtttgatggtctagcagggatcaaaatgagctggctttctgacccttcccttcatctctgcttcctaaagaatcccacattggttgctgcaaggacttccaattgctgtcagaactttcagatctaattagattggattttaattactgcgtcagcagtgagcctgatctgacttttggagagctaaggttgacccccactaagggtgcaaccgcccaagaaatgcaaagtggctcactccatttagacttggaggccaaatgccagaaatagttcagaaaagtagtggtggctggctatggaagcctcttccttaatttgagtagctctcttccctgctttacggagcagtggagatggcggcccaaaccaaagccaagtaagtaatttacaagtgaaggcacatgcaccttcctgagtgctgacaggatgtatttccaatttaccaagtggctgcaggtcctcatctttcttggctgtcaacagttaagagacgattattttaaaatatacaatctaggacgggtgtggtggctcagcctgtaatcccaacactttgggaggctgaggcaggtggatcacctgaggtcgggagttcgagaccagcttgaccaacatggagaaaccctgtctctactaaaaatacaaaattagccgggcgtggtggtgcatgcctgtaatcccagctactcgggaggctaaggcaggagaatcgcttgaatctgggaggtggaggttgcagtgagccaagatcacgccattgcactccagcctgggcaacaagagtgaaacttcatctaaaaaaaaaaaaaaattagctgggcgtggtagcacacgtctgcaatcccagctacttggaggctgaggcaagagaattgcttgaacccaggaggtggaggcagtagcgagctgagactgcgccactgtaccccagcccggacgacagagtgagactccgtttcaaaaaacaaaaacaataaaatgtacaatttaaacaaggtgtctcagatatctactttgtagcactgcattgatttgcatttggcgagtttcctttaacatcaccatacttctcccgcatcactgacctcctcaggccaaaactagaccagcgttcttttgtgtgtgtgtgtgtgtgtgtgtgtgtgtgtgtgtgtgtgtgtgtgtgtgcgtgatttaagatggctctgtcatcctggctggagcacagtggcaggatctcagctcactgcagcctctgcctactggattgaagtgattctcatgcctcggcctcccaactagctgggactacaagtgtgtgccacgcccagctaatttttgtatttttagtagagactgggtttcaccacgttggccaggctggtctcgaactcctgacctcaaatgatctgcccacctcagcctcctaaagtgctgagattataggtgtgagccactgcgcccggccactagaccagctttgtttctgctaaaagtagatctgagcttatcatatctgttttttcccctagaagacaaacaacctgaaaactatccacttaagaatgctgaggctctctgcataggactgagtactgagctagggacagccccataagctagttgatacctgaacagggctgcttatgaaagtcacagaaaattttcatcttttttctgcaacaccaaagttcctccaaggaaaatatcagcctggccatccaagtataaaaacagcaatccactaagtttattccttacccgaggctgcaaacttcaacacagtctacaattcttcaattactagaactgtaaatagcaagttactaacaatggagaaaaagaaaacaataacaaaacatctaataccgccctttgttattcaaattcttttccacaagttagttcccaaagatctcttcctttgctgatgattccttttaagcttgccaggagtgcagtgcaaaagcagtagtgggcaaagatttatgaatataagaaagaactggccgggcacagtggctcacgcctgtaatcctagcactttgggaggccaaggcaggtggatcacgaggttaagagatcaagaccatcctggcctctctacgaaaaatacaaaaaaattatctgggcgtggtggtacatgcctgtagtcccagctactcgagaggctgaggcaggaggatcacctgaacctggaggtggaggttgcagtgagccgagatcgcgtcactgcactccagcctggtgacagagtgagactctggcaggttcactttgggcacaatgaccccgcttctgtaaatgtgtcctcacctcaaagcgggggtgacaagaccactcactgaaacacaggaaggcaaatcctagaatgtattaatatataaataactaaaggaaaaatctcattcctcttcattcctgcttttatgacttaacatgtctgcaacatattcatgtggtagtaaatgtttggtattctctagtcacgatgaacctggaaagtgttgactcatgggctagggtaagagaaaggagaatagttcaaacagcttctacagattggtttctaagaatcaggatgggaacatgtgcacagtgaactttcagcctttacgaccaaccacctgctgcacttggacatctcaaaagcacatcaagtacacactgtctaaaaccaagcctactaacttccttctcctttcgggcttctaggatccccctaactcactaaatggcattagttgtgaaagccaaaaatctaggttgccatcattgactcatctgttcccccactcaccctgtcacaatccataagtcactccggttcatccactttatccctctagaagtagtcactgtcattaggatcactcctgagccgggcacggtggctcacgcctgtaatcccagcactttgggaggctgaggcaggcagattgcttgaggtcaggagttcgagacccgcctggtcaatatgatgaaaccccgactctactaaaaatacaaaagttagccgaccgtggtcatgcacctgtaatcccagctacttgggaggctgaggcatgagaattgcttgaacctgggaggcggagtttgcagtgagccgagatggcaccactgcactccatcctgggcaacagagcgagactctgtctccaaaaaaattaccgcctaatttcttccgatgcattttcccttaaaatttacaaatattggctgggtgcggtgtctcacaccttgtaatcccagcactttgggaggctgaggcgagtggatcacctgaggtcaggagttcgagaccagcctggccaacatggtgaaaccccgtctctattaaaaatacgaaaattagccgggcatggtgatgcgtgcccgtaatcccagctactaggtgggctgaggcaggagggtcacctgaacctgggaggcgaagactgcagtgagctgagatcgtgccactgcactccagcctgggcaacaaagcaagactctttcaaaaaaaaaattacaaatattatgacatagttcacaaacgccaaagcaaaataatatataaatatgcacaccataaagcatgttaacaaaatgaacattcacacactgactagccaagttgtgaaaacattaccatcatcttttaaaaatgtaaatataaccaaatcactctttgcttacaatgcacataattcagccacactggtcttttcgatttcccagttctggctgcctcttatcttaggatctttgctgtcacttccgttaagaatgtgctctcccaccttcattctccacccgttaacctctcttatgaaatcctcctgagtagtcacgatttccttcacaagcacttaccacatctggaatgacacagttctgactgattgttaaagaccggaagctccatgtgagcacagacagcatcttttctgctcatcaccgcatatcttgtacccagcgtaatgccctggcaccagtacctgtttgctagatgataaaacgaagaggaatttcctgggttgtggataggggccagtggaagaaaaaaaaatctcttacaatttcataggtagcacagccattccttatgaaaattatcattcttccccatcagtaaatcctacctttaatgaattctagcctatggggccatatatttcaaaggattgcctaatttaattgctttggccttgatacgcttcaagaacacagcaatcttctactagtgggtctctccatattaatttccactcatttcgctatcgcccatctgcaacagaccttaggactagtatttttatttatttatttttttgagaccgagttttgctcttgtcgcccaggctggagtgcaatggctcgatcttggctcactgcaacctatgcctcctgggttcaagcaattctcctgcctcagcctcccaagtagctgggactacaggcgcatgccaccatggctggctaattttttgtatttttagtagagacagggtttctccatgttggtcaggcaggtcttgaactcctgacctcaggtgatccacccacctcagcctcccaaagtgctgggattacaggcgtgagccaccgtgcccagccaaggactagtatttttaaagttcgcatcttgactttgaccttgctcgaccaagaatttattcttggaaccaaaaatcaagaggtgaataattatccttttctagtacatagctcaacaaaattaactgataacaacttttaagtatatatacactgtgaaataaatgttctgtaatagtacatgtgaatgtaaaacactaaattcacaaatacgctttgtcatgaatcagctatgtgccaagacaaattccttaaccgtgtttacatcatcttaagtatcttaagaaaaatatgatgtgtttatcatacattatttaactagaaacaaattgttattctaaaaggtcaggaaaaactattctttatgtatgaaatgaagttatttctacttattttagaggctatatacctatacagagaggccatacttataacatccatggatttgactggcatttaaattcaggttctgcagtttacaacagtaactcctggaaaagtctcatttagtttcctcacctatgaaaaagagaagcattgcctatcaaacaggattacctgaagattaaacaaaataacataggtggaagcacctgtcatcatttatactcaaaaaggttttttaaaaaagtgaacagacatgggatagcatggtagcgtacataggttacaaaatcctaaaaagatagtaagttataaagaaaataaagcatagtggctcacacctctaatcccagcactttgggaggccgaggcaggtggattgcttgagctcaggagtttgagaccagcctgggcaacatggcaaaacctcgtctctacaaaaaatacaaagattagccgagtgtgatggcatgtgcctgtggtcccagctacttgggaggctgaggtgggaggatcacttgagcctggcaggtcgaggttgcagtgcgccgtgattgcaccactgcactccagcctgggtgacagagcgagaccctgtcttaaaacaacaaaacaaacacacaacccccagagtgcttgtttatattaaagcaaatggtcataaaatattggactaaaccttaaaataagtctgcaccttcagtagcaattaaatatttgctttcaaagggaaaggactggcatgtggacaaggcctcatgctggctggctataaaatgcatcactgactcacatacgtaaactaccttagtattaatgacttctaaaaaacttctgagggttttgcttacttgtgttttctgcagtgaagcatagaaaatcctcctctccttgctcctttttccttttcatagctctgagctgttttgcccactcgcactagttactgcacagcagggcggccaggtcagagctctgggctgtgtgctacagcttctgcagtgatgacttcaatctcctgacctaacttgacaagactgcaactcttcccagcactctctgcaggggaaggtgtgcgctgcaatgaattccaaacattgctccctttctgaatggtgccttggttgaacagatttggcctctcttcctcatgcgagagatgtttcctttcagataaaatggagaaaggatgtgaagaaaactcttgtaagccatctctgtagacctccgcacaagtattttgtccatttttcagtatattttcttgacaattagataccaggataagacttaatttaacatttataaatatttaagaaaaaaaggaatcaatttggaaaacttttatcaatcaacaagttatcaaaacaagggtttgctttttgacagtgaatgtacaatattatatggtttgccattatttcctcttttggaagaaaggtaaaatgagaaatacattatataagtcattataagttcagtagatttttaaaacacttgagacacgagttagaaaaaatgcaattgaataaaccaattgtaagacccatctcaaaacaacaaatttaaatatgaaccacatattagatgatactaagtaattattgtttttgttaggagtaataatatcactgtggattttttaaaggccttactgaagtattataagtgaaataatttgtgtgatttgctttaaaatattccgattttaaaaattttgtgttggatggatgcagtggctcatgcttgtaatcccagcactttgggagacagagataggattgcttgaggccagaagttccagactagcctgggaaacatggcgaaaccccgtctcttattttttttaaaataaagaaaaattgtatgttgagggaggaggggtgtggtggtggtggtgatggtgtggatagacaataaatatgataatagatcgcagtactcttaacactgctgttgagatatatatatatatatattatatatatatatatatataaaataaacaaaataatgggatttatatatgtggcacccagtacaatgtacaattttcttttttaaaaaagtatttaggttatgcattgctaagcacatctgtgattgatgagagtgactctagtatctaaactgttggaggagggttgtaagggtaacaggtaggggaggcatatagaaggaatatgttggtatcatagatttcctaagactcagggaaggccacagagctagggtactagtctatgctagaattaatggattatgcaaccgaagaaagacaacttttgaatgaaaagctctctctgtgccagacttgaggtcaccaagcatcctgctcacactctgcgatgtctgtggagtagcacaccaccagaaactgctgatggaattacatcttcaagattcaaaatgtttagatccaatatatctaatccataaaaataaagcattctttatgctgaatgcagtcctatgcagtcaagaacaataatctagacatttttcatgtaggatttaaataggagtacaagtgaattaaaccattcagataaaaacgcaactaaagatgcattagctgctttgagtcaatatattttgtggtcaacctgatactccatccacataaaaaaggcattctatttctttattttttttttatttgacaagcagcagtatcatgtttgtcattttaatgtagatacaattattaggttatctgtcatattacaatatttaagtttttaaattttatgtcctttaagatacattaaaaaaaaaaaaaaagacacatcaactgcaaacgtgaaggggagaaaaagcatggtacccaaccgaatttccacttttcagcaatacttcactcattcttttaataaagttttaagaaatgtcataatgacatgagcttgaaatatctctaggcattttctttgacgctcatgacgtggcactggtgatgttgtaaacagcagaaaacaggggctgccaaatgaccaaattatggaggcacagtcctgctttttcccacaggaacacaccaaatggtgatggcaatgatcttctcacaccacgctggaggagagcgacatcacgcgacgtagctgtattcatctgccgacgcctggctgcgttctatgtattgtttgtctatcagaacttcaatacacttcttaatcatgctgatactgggattaaacctagctcttgactggctaatcacctgtggaagagatgtggaagtcaaactactgccagttcttcagctattaagtaatgacttttaaccaatcagtttaaagtgcctcaaatgtactgaggtttcaacaaatgggccaaattaagtatgaaaataggaactacaatgtggaaaatggatacagcaaaatctaataatgatacataattaagtgaaacaataaactaattaacctaagtactcacacacaaccccaagcttctatttaactcaactctcagctcttagttcaaacactttctcaagaaagttttccccagcagcccctaggccaggatatttaaatacattctcatagtactgtatacgtttccttcagtgcatgctaatgtaattttacatttatttgcatatcatttcaatagtgtatttcttcccccattaaactgtgaactccaaaaaagcctgccatatcttcagctgctctgtgctatatcccagggaccagcccagctgtctatcacatggtaggctcagatagttatggaatgaatgaatatctgatgggtcaatttccttcaataactggacagaagactcaatgaatcagcaagttttagacctctaaaataaagccaaagcaaatatgaatttattattatcatttgagatagcatctcactgtgtcacacaggctcaatccctgggctcaagcaatcctcccgcctcagcctcccaagtagttggtactacaagtgtgccgccacaactggctaattttttaattttttaatttttttttttttttttttttaggtgagatggggtctccctgtgttgcccaggctggtctgaaactcctggactcaagtgatcctcctgtcttggcctaacaagacattcagattacaggtgtccactgggcatggtggctcacacctgtaaccccagcacttttggaggccgaggcaggtggatcacctgaggtcaggagttcgagaccagcctggccaacatggtgaaaccctgtctctacgaaaaatacaaaaattagccaagtatggtggtgcacgcctgtattcccaactactcgggaggctgaggcaggagactcacttgaacctgggaggcagaggttgcagtgagccaagatcacgccactgtactccagcctgggcgacagagcaagactctgtctcaacaacaacaacaaaaaggattacaggcatgagccactgtgcccagcctgcaaatctgaatttaatactgaaattgtgagtgagtacgattctgattaagtatgaaacatttctttatgctatctgaggatcaggttatttctgtatcctctttaagaagaaagagactgaatctgtacaatgacaatgccctctaccctaagaagccctgaggactgccctccttttacctcttgaataagggcattgtgccgaagcacttttcgtgctttcatgatacgaactatagcagcttggagatacattttccggtcctcatcaactgcacttctagtctgctccatttcctgttttacagaagaaaagaaaaaagacccaacaagacattaagtcactgaacttgttttcaattcattttatcagtgagtgcaaatacttttttttttttttttttgagacagggtttcactctgtcgtcctggctggagttcagtgactcgctctcagctcaccgcaacctccatctcctgggttcatgtgattctcatgcctcagactcctgagcagctgggattacaggtatgcaccacaatattgagcaaattatatagttatgttgtgccaatatcacataaccactgctaaaacatctacaatttctagggttaaagttgaaagattagaaaaaaatttacattattgtaaactgtactgttaaggtaaagaggcaataaaggaggacacagcaataatttgcaagatcattttcttatcagtgattacagaatctttcatgacgcttttagatggagttgtgtcaactgcagtaattagctccaaatgcatactggatcaggcttcaaagggaagagctgtgaagtggcattttatgtggctcaagcagagaagccaggagagggggcctatctccacggagctcaagaaacacagaagcaaggcatagaagcagaccatgccacattaagaggatctcctcacagcgtttcaaagacaaaatacaatctatatattgcaaattattatttattagcctggaggaaaatggaatcttgaccattttaggtttcaaagtaaatggcagttaatatttgtctccccccatcgggaattaagtttctggagagggtctaacatcttatattatcttcacatcctgcatcagcccaaggactgcacaccggaggcaatcaggaagcataagtgatagaaacagtctatcccagaccaaagcaacaatcactgctgagttaaaataatgaagagcagaagtcccctcctcacactggcctgtcagtacctcactccacacccactagatcacaatctgcatttgaacaagatgcccaggtggctcatttgcatatgaaagtttaagaagcattttctactgacaaattttctttgaaagaaatgagctgtaggccaggcgcggtggttcacacctgtaatcccagcactttggcaggctgaggcgggcggatcacgatgtcaggagatcgagaccaccctggctaacacagtgaaaccccgtctatactaaaagtacaaaaaacaaaattagccaggcatagtggtgggcgcctgtagtcccagctactcaggaggctgaggcaggagaatggcgtgaacccgggaggcagagcttgcagtgagccgagatcacaccactgcactccagcctgggcgagagagcaagactccgtctcaaaaaaaaaaaaaaaaatgaactggagaactttcccttattttacaaatgaaaaatatgaaattttattacttctcaatgtgggaattttcggagagaatgcatagttacacattctaatggtttaagagcaaatacaacaaaaccatacccttttccttagaaaaaactaaaatacaagtagagatttctgtttgactgtaaggttaataaatgccaacaacaaaccagaaaagacatatcccattattaattttgctgtgcaaagttttgcacaatctcaatgtaaacacttgtaaagtccaatgcttaaatgtttccccctcaaaaaaaacttgacattaaaagcacttacttgtggtgtgtctttctgcattgatgtagtaattttaaattttgttcttttactgctaaagttcatatttaatgaaaacgaagattctgcatcaatatcttcctacatttaaaaataaaacatttatatttataaaaaccaaaatctttaaataagagtttgctgcaagcaattctgctaaattaatgaccaagcaaaaaagcctccactctcataacttttatattatagattaccaaatttaagagaaaaataattcttttgttcaaacaaacaggaaaaaacccaattattttctacttttacatctgccagaatcttaagcagtttatgtttgggaataagctattttctggtcctactattctatatacactactttttgataaaataagagtcaagctcattgcctagagtttgacattttaatttttatgaaacaccaaagtgcgtaacttttccatcaccccattttgaaaaagcaaccacatttttttttacaaatgccgcagtaacaaaatacccactgtaaatggcctgatgacaagagaaagctgtgcctccagtagcacacagcatcaatttgctgtgacctggggtgatggtgaaaacatttatttcaatccatgttttattcactcttcaagaagcaagtggcctttgctcaggggaaaactgtttaggcaatttttagaataacaacttctgtatcaggcttaagaaagccactgatatcatagagtggaatttctctggcagcagaatcaaaaggcacttggaagatgaaataattctcaataataatctaagacattctgctaaggaatggacagattcataattaaatttaaaggccaggcatggtggctcacgtctgtaatcccaccactttgggaggctgaggtgggcagattacttgagctcaggagtttgagaccagcctggccaacaaagcaaaacccggtctctactaaaaattaaaaaattagcctggcatagtggcttacacctgtggtcccagctacttggaaggctgaggcaggattatcacttgagcccaggaggtggggattgcagtgagctgagatggcaccactgcactccaacctgggtggcacagcaagatctcatctcaaaaataaataaacataaaataaaatttaaagtgcaaacaaggaatctatgtttactttgtcaatttctgggcagcaaaaatagcatgttttagaaaaaaatataaaacctttaagaatttactagcctaaaattagaaaccataattaattaaccttaagaaatccctattttggccaggcacagtggctcacgcctgtaatcccagaactttgggaaagacaggtggatcacctgaggtcaggagttcgagaccagcctgaccagcctggccaacattgtgaaaccctatctctactaaaaatacaaaattagctgggcatggtggcacgtgcctgtagtcccagctactcaggaggctgagacaggagaatcatttgaacccaggaggtggaggttgcagtgagccaagatcacgccattgcactccaccctgggcaacaagagtggaactccgtctcaaaaaaaaaaaaaaaaaatccatattttgctaagattctgatgccagataaatcatttctcaaaattatgaaaacattgatttgaatttcagaatatgccttttacagttgttcagttatagactataaaatgtcatcataatcctagggatgtcagcaaaatgaattaatgagagaaataaactgtaggctattaactttacaaaaataaaaacaaaacattatttataggaattttttcttataagcacaataatttgaaggagatataatcccacctctgttgcatttttaactatttaaacatctaggatatactatgacaacaaaacagcaaaatcttgtaactagaaaaaaagttacagagaaaaaaagtaatatactaatggcttgttattcttgtgacagatattaaaaatatatggtggttaaaaacagatgacagttaattgagtgctgacattaagaacacttggaatggagttacacatattaaatatgtgtacaaacagacatcaacaggctgtcatttcctgttatagaaccatgaaattaagcacatttataaaaccaaaaacctggaaagtctttaaaggctagtttcaaaatctcaattaatcaaaatcttccagatggcaattcttttacaattattcaataagctgtaacagtataggacaaataaaatcaaactataaacggcacatggcaccaactcacacagcatgctctgtgatgccttaacgctcgcagctctatggagcgtacagtaacgtagtgaatacaagtgctttccagagcacaataacaattacagccttattttaaaactgcaaacatctcatgaaaaagctttaatgctgatgatgcttaaattctttggaatattactacataccttttctgaatcatggttaatcattttcacatcaagtaatgatttgattgtttttgtcagttccttttcattcatctgagtgctgtcctgaagctctttataactgacagtttcactgttgttaaaggcaagaagaactgccatttggtatgttgtaaccatggctacatatggtttgcccaaatagttcattttaacttcacctacaattaaaacaaaaactgacagtgaattgaccattcaaagaaacatttcaaatttactttatttcagacattttcttcggaaagagtgaaccaataattttattaaattgttgtaaagccactgctgttaacaaggtagtcattttgtttcttggggaggtgaggatggaagtctattagttttgagtatatggtataaatcagtaaaactatcataacttcaccagtaggttaaaacagtctttaaggccaggcgcagcggctcacgcctgtaatcccagcactgtgggaggccgaggcagacagatcactttaggtcaggagctcgagaccagcctggtcaacatagtaaaaccccatctttactaaaagtacaaaaattagccaggcatggtggctcatgcttgtaatcctagccacttgggaggctgaggcaggaaaatcacttgaacctgggaggcggaggttgcagcaagccaagatcacaccactgcactccagcacgggtgacagagcgagactctgtctcaaaaaaaaaaaaaaaacaaaaaaaaaagtctttaaatattaatagaaatgctaagacttaggcagaaaaagaaaagaacaaaaaacccaaacaataaaaggaggtgggagaaggagaaatggacagacaaagggcaaagtgatatcagcaacagcctcaagtgctgtcgatagctgggctctcccaggtaaggttcaagcctcctgggaggtccacagccacatggaaaatgcttttgaggccctgtctaagctgtaatttctgccaaaattaatgctattatgtctcataaacaacatttttctttccagtaacttcctagaggcaaacaggtatgaaaggagagacaaacaggcagacccattctcttgctgaaagttgatagcaaaagaatctgaatgttttcataaaaatgtttaatctgaatgttttcataaaaatgaaaaacatttaatctgaatgttttcataaatatgttctatatgtgctgggcacggtagcttatgcctgtaatcccagcactttgaaaggccgaggtgggcagatcacttaaacccaggagttcgagaccagcctggtcaacatggcgaaaccttgtctctactaaaaatacaaaaattcgccgggcatgatggcatatgcctgtaaacccagctactcgggaggctaaggtataagaatccttgaacctgggaggcagaagttgcagtgagccaagatcacaccactgcactcaaacctgggcgacagaatgagtatctgtctcaaaaaaaaaaaaaaaattctatatgctaaatgaccctgggagctctaagagatagagcaagtattatgtatactacagttctgcaacatcctgggagacagcagcatgacatcagcacactgaaagctcataatgaataatatggcaaacatgtctacactctgtaatgttccatacgtgtttaaaaaaaaaaaaaaagaaaagaaaaaagatgcagatcaaagagctgcttcctaaagcacgaagttgtggtttgacgactaacacacacacggcctgcattatttgattgttgaatggattataaatgaaattgggccaggcgtggtggctcacgcctgtaatcccagcattttgggaggtggaggcaggcggatcacgaggtcaggagatcgagaccacggtgaaacccctgctctactaaaaatacaaaaaaaaaaaaaaactagcagggcgcagtggcggacacctgtaatcccagctactcgggaggctgaggcaggagaatggcgtgaacccgggaggcggagcttgcagtgagccgagatcgcaccactgcactccagcctgggcaacagagcaagactccatctcacaaaaaaaaaaaaaaaaaaaaaaaaaagatgaaatcaacatgagatttgattttaaagctcttcattgttaactcaaggaagctgtatttctcataaaattaccccagagactgcattttccctctcaaggataattagtaactctgattaaggttttctgctttatgtattcattacctcattaaagattttaggccgggcgcagtggctcacgcctgtaatcccagcactttgggaggccgaggcaggtggatcacctgaggtctggagttcaagaccagcctgaccaacatggagaaaccccgtctctactaaaaatacaaaattagccgggtgtggtggtgcatgcctgtaatctcatctactccggaggctgaggcaggagaatggcttgaacccgggaggtggaggttgctgtgagccgagatcgcgccattgcactccagcctgggtaacaagagcgaaactccgtctcaaaaaaaaaaaaaaaaaagattttaaaggctatgagtgaattcattagcttaatatcaccataaatgcaatattatcttgattattatcatttatgccttgacatttcagataaaactgatatttagaaacatttttcagaattatctggatgggaataccaagagaaaaaattcatagccctctaaattttcacaaaaggaggtttaatatattaaattcaatatccaattcatagaaacagcttgtgcaaaaaattatcatttggagtatactattaacaatttctataaaaaggactcttatcaacatttaagtttggaaaatgtaagtaaaacattacataaattgcattttgttatttctgcaatgacgacttaatcatatgcagaaataagtagagaattatgcatcaagcaccaagatgattaagtggcaccatcagccaggatgtcactgatgctgtaatatgctgccgtgggtttgaaagcagaatgagtcttctgccgtctttcagcaccacgagacccaaagagcattaggagatcatgcgaggggccaaagcatcatttacttcttattgagttcattctttcattgtgccctttcttgctatttttcaatactctaccagggatcaggggtacactgacctcttcccacttttcttagcaccatactcttactgaaaagactggggaaggggtgggaagacacgacaggggaaaggaaacttcaaacttggatgattcatttaattactgtggtgtaaacacaaatgagaaacaacaagagtggtgatttaccctgcagaataggttggcaaaccctaagagactaaaaactaaaataaaacattctgatacatgcatacttaaagtaagccaacaataaataattcaagcagcatttacaatgacaggaaataaagagcgggcagaactctcacaatagtttcatccaagtcactccccagtatctgtgtcagctctctactctctcagggcaagttgaaggcatgataggatatcaccattttgcaaccagtaatgaaacaactgattctggcaaggatcatcagtggaggctaaaactacattaggttcctggaacagggtattcatgccaaagtatcatccctcagactgtctgctaagctaactgaagaggggaaagagtgcctctacaatggagatatctggtggttaccgccttcatcaagtgaccaaatttagcatctctaatagtgagacaatctgacattagatgcctttgaaatatgcaatatgaaatacacaggaccacctatgaaatatccttgccaataatacttaactgaatataatcaaacctttagaactaatttccactttccagaacatacaaggaatagaaaacaaatttaaaaaaaaaaaaaataaatcacaaataagtaatccaaagtactggatattctacaagacaactggcctggtctgttcaaaacagtgtgtcaaagaatgctgagaagtggggaggtggaagggaaatgtaacaaccaaatacaattagtgacctctgacagtcaagcaagtcaccttgggacagtcagggaaatttgaatatggactggacattagacaatactaacatccctccctatttttagctgttggaattatttgaaaacaaaagcaggacaaatttagtcaatagaatcgttatcttttaaggtatgcacaatgatatggtgttacttttattctggcaaacactagtaactaccaacacatactatgatgtagggttcacaaaattctagcctgatccatactatgtactgtctggtgaagttttttttatcttccttgagttcatcatttctcaacgtgtctttcagcaactgaccagcaatctctacaacttcttgctctgccacaaataaaacttatttatacaaagacagtgtaatggtttctgtcacactgtctggttatatctctttatcaagtatctgtatgtctttatcaaactgttccttatcgttaattctatccaaagccttagtcataaatccagtggaattttcaggatttttctcactctgtcacatctggcatcacagattgcttcttaaaattcttcctctgttggaaatacactctcaacactctcctttacgtagcttggttaagtcctattcattctttttattttatgggtttttttttttttttttcaagacagggtctcactatgttgcccaggctgatcttgaactcctgggctcaagtgatactcctgcctcagcctcccacagtgctagattactatgaccttatttaaccttgatcaccttctcatggaccttaggggttagagcttcaacagaagactttgtagggagcacattacagtctctgcaagccatggacatggtgacaattttattccattctaactgcagattaaattaacctccatgttaatctgcagcatgttttctttctttctttctttcttttttttttttgagacggagtcttgctctgtcgcccaggctggagtgcagtggcgtgatctcggctcactgcaatctccgccacccgggttcatgccattctcctgcctcagagaatcttattttctgcacactgctgtgtataaacatacatttttttatatatgtatgtatatatatacacacacacacatacatacacacacacaaatatgtagtgataaaactatatagatgatatttccataattaatacatgtttatattaatgtcaattttaatgtatgaatatgtattaaataaaaacccatttcatttacatatacatgtatatccttccttccttccttctttcatttattattttttattttcatttatttattttctttttgggcctgcctggtcttctcactctgggctctggtgacctcagcctcccaagtagctgggactacagggatctcttaagcccgggaggcagaggctaatgtgggctgtgatcgcgcacctccactccagcttacgtgaggtggggtgaggagaggcgaggtggggtgaggtgaggcgaggtgaggtgaggtgaggtgaggtgaggtggggtggggtgaggtggggtgaggtggggtgaggtggggtgaggtggggcgaagtggggcgagggggcacccggccctattagctcttgaaaacaagttgagatgtgatttccccagaagacttccctcgcaaggacctgactgccaccaccattctgtgatatgccctgggctggcctctatcacattcaaaacaccgtactgtaactatgtacgtatgtctgtcttcctactagacatgagttttttttgagggccaaggctctgtattttatttctgtccacttggcgtttagaagtacctgagacatagaaaatgttctttgagttgatcaatgaattttacaacaataaagagaaggaaacaggctcaaaggagttaagtaatttgcttaagattacacagctaataagttgtgagctaataactccagccacaggtcttctgattctaaattcccccaaacaccaccttgtgcaccatcaaccatttgtgaagactcttcatttacaatacaaaaattaaccttttcttgggtattccatgagctgggaatgtagaaatagactaggcaagaataattttcattctatgtttaagcagaagtaacaggggttctcaagaaacagaactctgagagatctgtccagcctcagagccagtgttttaaagaagtcctggagccttaggccatatatgggtaatctagaacaagtatcttcaatacacatagcgtgtgagaaactttttgttaaatgaataaatggagaacaaaaataaaatgaaaaatgttgatcaaaggggacaaagtttcagttaggaccagtaagttctggagatctatcatatagcatggtgactgttaatctactgtggagtaaacttgaaaattactgtgacaaggctgggcacggtggctcatgcctgtaatcccagcactttaggaggccgaggtgggtggatcacgaggtcaggcgttcgagaccagcctggccaacatggtgaaacaccgtctctactaaaaatacaaaaattagctgggagtggtagtgtgtgcctgtaatcccagctactcagaaggctgaggcaggagaatcacttgaacccagaaggtggaggttgcagtgagccgagatcgccactgcactccagcctgggtgacagagcaagaccccatctcaaagaaaaaaagaaaaagaaaattgctgtgacagtaattgctgtgacagtagatgttaaatgctctcaccacaaataaagataagtgagaagctacttatgttaattagcttgagttaatcattttacaatataaacataacaaagcatcacactgtacactgtaaacagatacaatttttatgtgtcaattgtatcttatcaaagttgggaagaaaaacaactctaactcctggtttcactgataggtcacaggtgttttcagtaccttcggtgactcaaaacaaaaaaataaacttataaggttctctttccaaaggaagtaactatttggttttaactaaaacacaaataatattaaataaaagaaatgaacaaacaaaagagctccccaaatcaacttatgtatcagcttagaaatttagtatagctcaaaaacagaaagaaagttattctctttcctatttaggtgatattggtgactattttcaaactaaattccaatggctaaaaaactatgtgcataaatttattttcttcttatacaccactggttgttaaaatgagccccttactaaaattactttaggagacacattgattattgctgaaataatgagaataaccaagaatgtttaaactcccccagacagatattcatggaaagtaaaagcaagctaaatcgaactgcactaagatatattagttttcttaggggaaaaaaaaaaaatctaaaaccctggtccagcatttttttcttaaaatcaattatgtttactaaatgaaaatagaacatattgattgactggttgagacagggtcttgctctgttgcccaggctggagtgcagtggcacgatcatggctcactgcagcctccagctcgtgggctcaagtgatcctcccatctcagcctctcgagtagctgggactacaggtgtgctccaccacgcctggctaatttttggattttttagtagagacaggttttgtcatgttgcccaggctggtctcaaactcctgggattaagtgacccacctgtctcagcctccccaagtgctggggttacaggtgtgagccactgcacctagccaaaagtcaaattaaaatttgacctttgactaccactaagagtatcagtaaaaaatctcatttcaaaaattattttaaaaattagaatgtccaacttgctcagtaaagatcgacttatataagtaatgcaaaatgtattactaatacaatgagccatcacgttcccaagatgtaaattagtcaaataaacaccaagtatcatagttacttggataaagtaactcttggggaggggatagaaaacatttcctaataaaggttatggcaaatgattttcttgtaccatctctaagaaatattagcatatataccctttccttcttgtacaaagaaaaagtgattcaatgaacttgtcaaagcatagtttagcaaaaaaagagaaaattcaagtgtctgctttggcttacatcttcaggcaactccacacacagtccacaataattcaggtattaatcctactgtaagtaagtggactccattgttccagaaagaagcaaaggaaattagattgtgataaaagttttttaaaattggaaactattgaaaattaagtaggactttctgcaaaaagctttactattgcattcactgcagtatcacaagtaaaaatcaaatggttaggtctccttatgatgctataataaagaaactggcaagaggatctggcatacttagagaacaagtttctaagtgtgtctgccccatcaaatgtgagtttctaaatacatttgctaatgaagtggttggctagagaaatgtaataaatcagtataaagtcagaacatttctttaaaagcagcaagattataaacagtgtaattataaaatactatgaaaaagtgctatacttggatttcattgttagttgctttaatggggaaaggttgatggaggagaaaaggttaaaaactgtaattgggccatagaaaacctctttctaaattaatataatcatcaggtaaatttcattaagccagatataattaaatgcattttacctgtacacagataatgtaaccatgtaagtttccttccactgaaatgttggctataaaataattcaaactgtaaaaaaaaaaaaaaaacacacattatttttagctactataacttgcctagttaattaacacaatactacaaaagcaatgaaaaccattcatattagaagagacattaaagcccatctggtttacctccttcttttacagaggagaaagcacgttcctgtggtccctaatcaaggctatacacatatattccagctcttttaattgacaacttgttctagagttctctccactaaaccacagcactgcaaatttgactttctgtatgacacagtgattcattatcatttctgaataatactaacatggactttataaattctactaaccaaacacagcaacatatatatttcaccatgaaaagagaaaccctaccttcatctctaatctcccatttgccaacatatagcttccacattcaattagacacaaatacgaagttttagggtatatctctggattattcttttgctgatattattgtgaacaattaaatttaaattctattaatgtagccttcaaattttaaacattcctccctggactgaatgtgtaattacagaacaaaaatacagagttcttttttctttaataaagagctagtatacaataaaaagtggaaaaatgatactggatgtgaaaaagataaaaactcaatttctttataaaactaaaaaataaactgcattatgccagttcagaattctgaataaacttttagcatgatgtaccatatataacatacttaaagcttttatttgtatatcaaactttaccttttgtactttaaaaaggaagttcacataaagcagtcagcaatgactgacctatcagctatattatgaccactccttaacagcaaaagttaatagctccagccaagaaaatgagtcaattccttcagcagttactctaagtttgcctagtcctgggaagctgaaatatgttgagcctattttccctctaatggtgcagcatcctcctctaccagcagatccaccaatccctttgcaggatgaacaggagatgactagcacctggaatacttcagattgcctgcttagttctaatccagacaaacagcaaattgaaatatgtcataagaggatttcagaagtatgatctgactaactaataactcccagggatatcaataaaattcaatcactactatataattcacaatttataacacatttacaatgaatctggacaaaagcaaaataaaagttaaaaaaactttcatttttttctcaaaacactttcggaaatgagaaattccagctttaaaatgctcataatttaaagtgcaaagctggctttaaaaggtatattccaagctctaaaaacatgttttacctcttcagtagtactatttggtaaagttttattgacgataatatcaata

SEQ ID NO: 78 - DNA, 57810 bp, Homo sapiens
ctgagagtagggctttagtgatatataccccaaacctaaagagactcatgtgtcaatttatatttattagcatcaacaacttgcttgtgccgatctatattttcgaatttggcttcgtttctatgtttatctctagttttcctgagtcagccttttctcattgcagcaatttaaaaagttatcttttcaagaaagcagtcttcttccattaatggcttaacttgtttttttcatagtggatcctgaaaaagtacacctttcagtagtctcagactctgaaaagaaagaattctatctacagaccagcaacttagcaaattaatgttttggttcattaaagcaaatcgcagttaaaacacaagaagttatatgacttctaaagtttatgtaagccttacgaacctttttcaagagagtcaattaagcagagtagtcatgaatgtgggttcctgggccagattgcctgggagtgaatcctggctctggttttggctaactgaatgatattgggaaattcattcagctgtgcggcaattgccctccctgtaaaagtgcaatagtagcagtaactacttcatagagtaattttaaattaaattcttcatggcatgagaagtgcttagaatagcaggtgaaacttatgtttttaaaattttactattgccaatgttttcatggtcattcttaatcataccttcagtagataggatgcttgttgagatggacagcgtgcctggattctccctgcaacttaactatcaaccagctgtatgacctggaaaaaaaatgacttgaccttcctgggcttcagtcctcttatttatcaaaagagggattggcctagataatatctaaatgtcccaataatactaaaatgcgatgatcctattatatcattcgccaattgtgagtttagagaaaatactttaaaagggaatatcaaaaagacctaataaaaataaatgaaaaggagagattgtgtttaaatttctcttgacttggaatcaggacaactggatcgaggcctggctgcttactatccttcttaacccaccccacctttcactcttgtttttctttttggctcagtatggctcttggtgagcatgttggcagaaagctgaaaaaggaaaaaaaaagctttgattgaaaacaagcagtttacagatgggttggatgtgtgcatggggtaggggtgcatgtagtcaccatctcgtctcaagaaacctgagagacattccatgttgagagaagtcacatgaagtgaagccagtggtcacatctaaaaggagaccaactcctgcacgttataagatttgaactcagaaagttgttatttatattcttgtttatttcaaaatatgcaacacgtgctagataagcaggtagacttatccagtgaatgctggataagcaggtagacttatcacttatccagtgaatgctgaagagctctctctccttgccaccctatggatcggattgcccccttcagcctgagttcttcccttcacccgttttgaatctggctcttgctcagtgggcagtatgatctaaaagtaagcctctctgtctcccaacaaggtaactctatttctgtttgtaaaaaaattttttataaaatatagaaaatttggtcttcagtctttatcatatatggaaaaccttcccttttctgaagagtgattccattagctaaaatattaagtgatcgaatactaaaacaaccaacttgactaacaccttttagactattcactcacccctgcctctcataagggagtttgaaaatttagggagttccccttcagcaaagaggctattgtccaaatagtgcatcatatgcacagctccatgcaggatgcttattaagacacccttattcatcctgagctgacccaaatgcaagcaaggctctctgagcttctttctcaagggcatagtgagaacattccctaccacccagctgtgtagtgcagtttaatgaggaaatggatgtgaacctgacttttagactagaaaacatacttccaattaggtgattattttaagcttctagctaaagatggcttaatgatcaattctgtcttgtagttggaaacatgaactgtttccaactcccaagagcttccagtttttccatcctttccatcatttctatgactctgtatgcatgttcttcatacatgagatgtgatcattaacaaaattcattctggtaccctttctgtatatgaattataatctacacttttattatcatcctttcatgttccataattccagtatttcctagctttccttccatggcattctgcttgtacaagtggaaaaatcaggtaaattacagaaatcaactagtctctttatataaaacagaaagtcatgaaatataaattaaaaatatacaatgcttttgtcataaaactacaaagtattcaataacagcaagacagaaaacagggaggttgcttcttccctattgagagcacagaggaagcccctctcatggtgttgagttgtctgtctccatcatggtcacagccctcttgctaaaaccagaaagatgcctctaggtggtgattttaaaacattaaagattttaagagttgccaactgcaaagagttggcattctaagcaaactgtaaagaatcctgtaggcctggaattgagacctgagctaacttgttgctggtagtctcaccatgcttgaatcctcacgaatgcccccccagggcagcatgccaccagaggcccccatcttctgctttgctccgtaggttatatgaccttgccttccagtcccaggaagcctgctgtcctcctgatgacaaaaggttcaagtgccctcagggatataagcatagaaggtaaattttacctattgcctgaaaacctaactcagcatatgagtcctttttgtgtctaccatttaatttttttgttatgttatatgaaaaacaaaacaggacaaagtgacttttaaatagagattgcagagggcttgattgggataaagcactttctgaggcatcatctcctttaactcttacacatcttggtgaggaggtagtatttttacaatgagcaaattgagattcagggtaagtaacttttctatatccccaaactagccaatcatttgtagatatattcagaaaactgacctcttcttcactaactctaaaaattgtcatatgtagaaaatcctgttataaaattaaccaattttatacatgttgtattagggttctccagggaaacagaaccatcaagaggaggtgtgtgtgtgtgtgtgtgtgtgtgtgtgtgtgtgtgtgtgcataaagagatttattatgagaaattgactcatgtgattatggagcttgagaagtcccaaaagctgcagtcagcaagctggaggcccaggaaaactgatagtgtaagttcctatctgaaaggtgacagattcaagacccaggaagagccagtgtttcagtcagaatcaaaaagccaagaaagaccagtgtcctagctcaacagtcaggcaggaggagttccctcttactcagcctttgtattctttggtctttgattgttggatgaggcccacccacataaggaaagttaatctactttgctccatccgtggcttcaaatgctaatcttatcccaagtcacccgcacagacacaaccagaataatgtttggctgaatgtctgggcaccccatgacccagtcatattgacatgtaaaattaaccatcacatgtgttatatagttcttaggcagggaacactggtgtttgttgactactcaccctgtgctctttgccaggcactggaaaagatttaatcaaagcaaacattattgtatttgctttggagagattggagaagacagggctgatctcaccatcaatagcctctagagtatcactgtccattagagatagagggcagtttacatacacaagccacatgcataatgttagtagccacatttaaaaatgtatttttaatacatttttaataaattctatttttattttttaataaattttaagtttatttaacctagtatgccaaaatagcattacaacatgtaaccaacatgaaaattattaatgagatactttacattctattttgtttttaccaagtctttgatcagtgtgtattttttagctacaacacatttcagttcagtccagccacatttcaggtgctcagcagcctctgactaatgcctgctgtagtggacagggaagccacaagtgtctgttgtagaatgctctatcttatgtatcttattctggtgtgggttttagacccaagttactgagggtttgggagaaagagcaactgtttggaggatttgatataacaccaggaaagtctgagtggtattagactttgtcaggacaagctgcttgggaaaatcagacctagatgctgggtagttactctccatctagagattgccaggactgcattgttagaaggttatctgttacctctggaccagaataggctggttcttgggcagccctgctcctagctactacttcctgctctgcattactcactgccacttctctcccaagccacagttactgttccctgctacaagaaatcctgggactgggagtggggaggctggtctacaaaagattgagccaaagcacactttatagaagtttcttcgttgcacaccatttgaggggaacatactctagcatcacaaggtttagctaatgtccccatcaaaagtacataatattatgtattctgctcacagttcccaccagcatctccttgtaaagttttgcagtttttcctaagatgtcttatatatgcccacactgtattcataagatgatgtgagaagtccattttctaacaaccctctcttagtcccatctggattactgatattaagatgcttcacgaacaccccttccctccttttttttttttttttttttttgagacgaagtctccctctctctccaggctagagtgcagtggcacaatctcagctcactgcaacctccgcctcccaggttcaagcgattctcctgcctcagcctcctgagtagctgggactaaaggcgtatgccacaatgcccagctaatttttgtgtttgtagtgagacggggtttcaccatattggccaggatggtctcgatctcttgacctcgtgatccacccacccctcggcctcccaaagtgttgggattacaggcgtgagccactgcgcccggccccacctctttcttaatgaagctttcctaggcaggctttttcgtgtgagcatctctggatctatttgctacccaccccattcttcattgcctgggagtctccttatgctcacagaactgccctttacgccttgctgggggaacttttgagtatcagtttgagggtgggcaatatcactgatattctatatcaagggaaaaataatttcaactctcaggaggccagagccagagaacagtagtggttgacccctgaatttggagataaaatatatttagaatccagtctttattgttctatagtggcatttcccttggaacagaattttgcttaatgaagcagagaacaagttctgttttatttttgagtcccctttgtcctattaaataaaaagtattttattttcccagaggaaaatataataatccctgaatggtgattaaagggtttttccctggaagaggaaaaataatttcataccctgctaatatttacaatatagtcagacttaattaagttatctaaattgcagttaattcaggcatttgtttctagatgcagaagctttgagtcagactactagttaaattatttcctctggatgagggaaaccagtgtttctctctctcccctcagatgcttttatggccattgttcctttctgggagaatgttatgtcctttgcagggagctccctccctggccgtgccaaaacaccttaaatgccacttccttctgatcccaccctagcacttcccacttgatgcttcctaaatcgcgtcatttgctgcccaaattgcacacagggcacacttgtgtgcacactcaccaaagctcatgcattctggtaaaccatctaagccaaattagaggacaacacaaagaactgatgaatagagaaaggtgtccagtccaatgcaccaactcatttatcatacatcagcttccctttctatttacattttcctgatctcagtcatcagcctttaatactaatacacaattttatgattattatcctttcaacacaaaagttctagaattgggctcaagttcgccatttccatgattatcaaatgttttatataaaatttaaaaaacacagcttgcaaagctgcaaagctaattataatcgtgtctctcatgttctgcctcactagacttttatttctgcagtttgcactttcatggctaatatgaagccttttttgtgcaaataccaactgactccttttacttttccataggaggggtcagggcttttgcagatgatgcctgaaccaaaaagagcagagaaagaaggtcatgatcagaggtgcctcctggggagatggagacttagaaggcaagaaccactctctagaatctagactgaagttctgacacaggtctccgggtcatttctctgcccagatagagccatttgatctagttcttatgagatgcaccttggtgatggtgctgccaagtgagacaatactggtttattttatttcattttcactatcttagagctcaaggtgagaacttctaactcacaaatgtaattgagtaccacaaaaagagctattttggttgtcaggcagcaggaacaaaacaagagagacaagtcactatgcctcaggtctcccagccatctgtctcgggggtgggggggttctctgaggatcctgagagaatggaaggtgcacgggtccctccaattgataaggctttctttcaaatcatgagctcatccataagccttgaaaaagtccttctccaagctatcattacatgataccacttcacacacagggcgccctgtccttcttaggagtgttctctctcttcttgcatttagaaaagtcaagtttttctaagcagttagatgctgtattctataagtgtaccaactaggtttcaaatacacagtttcctactcattgattattattattttgaattgtctttgactgttggacctaaagctaaggcctgcacataaccacataagctaccctaaaggcacttggcttgatataagtttcacttaactttcctagtcccctttcctaacttccaaactgattctttgttagcagcctgatgcatggcctttcctgaaatgaacataggtaaaggggtttctctaaagttcttagctcaaactctacttcctatctgattaagtcacaggttttctcccagtggttctcacctttttttttttttttggtgctgggttgggggaatatcatagaccgactctagaactgctgaacactgtagaccttcctttcagataattgcacatgcaaacaaactccaactagttgcagattattttaataccccgtaatgttcattcaggagccccaggttcatctatgaactccagaggtaggatccggttgactgtaagaatgtctttcctttcaataaaaatgaaaatctgctcaccagatgctgaaatagagacaaagttcatattgcaaactaatttgattgtttcaggtcttattttaatacagtgaaaatagtagttctaaatatttgatcagtttggattcagtatccagaggaatgtctgcatattaatttaatcaaggaaaggaaaagaatgaaatggagggtcaccactagaccgtttcagaatagcatttgcaaacgttattgtcctgattagtgtgttttcccctttctgggtaattataagctgttcataagaacatgctgatctcctagcatttaaatggcacttccttggtctgatacttggagagtttctgctgttttgacaagcatctgctccaggcagtttaatcctgctgcctacttttcatttctattgagacagaaagaattttatagtaattgttggttatttgaagggctataataaataatcatatgagctcttattcaaattgtgaggcgcttttactctctaataagttcaggcaaattagccagtaaagaacagtttgctttagataaataatatattgaaaatacgggtaacaatcctgacatttatatcaaatttcagtctttaggacaagaatgcgctaacatactataaaagctgatttatctagcatctttttagaattttctctacatagtaatacttttgaaaccactaatactgaagattgtgatatatatggagctgaaatgcaagaatatggtaatatactataaaagctgaattatctggcatcttttgggattctctgtgcatgtcaatactcttgaaaccactactactaaaaatgttgatatattaacatatgaagctgaaacacaatgggaatcattaaggactaaattattatctcaaactgtttattttcctgtttcatattttactcccattatgggcaagttggtgatttatgcttgatagacctgagaaatctgtcactcagaactctttgtaacagtattactatgtccggaattggttccttctggtgggttcttggtcttgctgacttcaagaatgaagccacggaccctcgtggtgagtgttacagttcttaaggatggtgtgtccgcagtttgttctttcagatgttcagatgtgtccacagtttcttccttcgggtgggttcgtggtctcactgacttcaggagtgaagctgcagacctttgtggtgagtgttacagctcataaaggtagtgcggaccctttatgagtgagcagcccataaagagtgagcagcagcaagatttattgtgaagagtgaaagaacaaagcttccacagcgtggaaggtgacccgagtgggttgctgctgctggctcaggtggccagcttttattcccttatttggccctgcccatatcctgctgattggtccgttttacagagtgctgattggtctgcttttacagagtgctgattcgtgcgtttacaaacctttagctagacacagagcactgattggtgcatttacagtcctttacctagtcagaaaagttctccaggtccccacccgattagctagacacagagtgctgattggtgcatttttacagagtgctgattggtgtgtttacaaacttttagctagatacagtgctgacttgtgcatttacaatcatttagctagacagaaaagttctccaagttcccacccgacccagaagccggccagcttcacctctcattactactaaataaatagtgtaaaaacttgaaaaacacagaaaagcacaaagaagaaagtaaaaaatacaatactatcctcaaggtgtataaataatgagagtgatttcactccacagggaagtttaacctgtaataggatagcaggaaatttaagttttcagtcatctgtcatgtttgtttatgctttcttcttttcatttcaacaggttcttccttttactcactatattcttcctccccctactctgtatggactacttttgtagtgtttatatggtatataacattttttaaaattttatagtcagtccaacatagtggttagaagcttgggcttctgaatctggctgtgtcaattccaaaccattttcattctgtgtgaaattggacaggttgcatttcctctttgtctcaactttatcacctataaaatatggatggttatcatactaaggtcctagggaggaactattgtgctaatgaggagtacatgaattaatacctgtaaagctcttagtgcagtatctggcatttaataaagattagctgttatatcagctattactgggaattttggttgtgcttttgaataaaaataattttctttttttctgatcataagttttataatgcttatgataaacaacactatagaaagtggaaaaacacaataccttccctcaaagagtagcatcctctcattctctatctgccaccaatggtttagtgttaagagttttgctatagctgcaactacatatacacttatctatgtgtgtatatatgtgtgtacatatcatatacacacatatatgtatgtacatatcacacacacatatatgtatgtacatatcacacacacacatatatgtatgtacatatacacacatatatgtatgtacataccatatacacacacatatgtatgtacatatatacacacatatatgtatgtacatatctacacacatatgtacgtacatatcatatacacacatatgtatgtacatatcatacacacatatgtatgtacatatcatatacacatacatatgtatgtacacacacaaactcacacaatttgtataggtaattttgaaagggctaatactaaatgctctataaactccagcttttttcatttgataaattctagagaccttttgttgtcaataagtaaatatttacttcataaaactttgtagattttttctctatggcttattcatatatatttttaattgtattgctgatataaaggaaagctgttaatgttggcttttttgccttatacccagttcccttactgaatattccaactagtttttaaagttgtatttagtttattatttagattttctagttaggcatcatatcaactgcaaaaacttgtctcattctttccaacatttatagttgtcatttgttcttttttttaaattatactttaagttctgtgttacatgtacagaatgtgcagtttcgttacataggtatacacgtgccatgagtgtttgctgcacccaaaaacctgtcacctacattaggcatttctcctcatgatatctctcccctagcccaacaccccccacaggccctggtatgtgatgttcccctccctgtgtccatgtattctcattgttcaactcccacttatgagtgagaacacatggtgtttggttttctgatcttgtgatagtttgctgagacacatgatttccagcttcatccatgtccctgcaaaggacgtgaactcatccttttttatggctgcatagtattccatggtatatatgtgccacatttccttaatccagtctatcattgatggacatttgggttggttccaagtctttgctatcgtgactaatgctgcaataaacatacgtgtgcatgtgtctttattgtagaatctttgggtatatgcccagtaatgggattactgggtcaaatggtaattctagttctaaatccttgaggaattgctgcactctctaccacaatggttgaactaatttacactcctaccacgttcctatttttccatatcctctccagcatctattgtttcctgactttttaatgattgccattctaactggcatgagatggtacctcactgaggttttgatgtgcatttctctaatgaccagtgatgatgagcattttttcatgtctgttggctgcacagatgttttcttttgagaagtgtctgttcatatcctttgcccatttttggatggggttgtttttttcttgtaaatttgttttagttctttgtagattctggatattagtcctttgtcagatggatagattgcaaaaattttctcccattctgtaggttgcctgttcactctggtgatagtttattttgctgtgcagaagctctttagattaattagatcccatttgtcaattttggcttttgttgccattgcttttggtgttttagacatgaagtctttgcccatgcctatgtcctgaatggtattgcccaggttttcttccaggattttagaacttatgtttaagtctttaatccatcttgagttaatttttgtataaggtgtaaggaaggggtccagtttcagttttctgcatatggctagccagttttctcaacaccatttattaaatagggaatcattcccccattgcttgtgtgtgttaggtttgtcaaagatcagatggtggtagatgtgtgctattattttgaaggcctgcgttctgttccattggtctatatatctgttttggtaccagtaccatgctgttttggttactgtagccttgtatagtttgaagtcaggtagcatgatgcctccagctttgttcttcttgcccaggattgtgttggctatgtggactctttctggcttcatatgaagtttaaagtagttttttccaattttgtgagtaaagtcagtggtagcttgatggggatagcattgaatctataaattactttgggcagtaaggccattttcatgatattgatttttcctatccatgagcatggaatgtttttcgatttgtttgtgtcctcctttattttgttgggcagtggtttgtagttctctttgaagaggtccttcacatccctttaagttgtattcctaggtattttattctcttcgtagcaattgtgaatgggagttcactcctgatttggctctctgtttgtctgttattggtatataggagtgcttgtgatttttgcacattgattttgtatcctgagactttgctgactttgcgtatcagattaaggagattttgggatgagacgatggagttttctaaatatactatcatgtcatctgcaaacagagacaatttgacttcctctcttcctatttgaataccctttattgctttctcttgcctgattgccctggccagaacttccaacactatgttgaataggagtggtgagagagggcatccttgtcatatgccggttttcaaagggaatgcttccagtttttgccaattcagtgatattggctgttggtttgtcataaatagctcttattattttgagatgtgttccactgatacctagtttattgtgagtttttagcatgaaaggctgttgaattttgtcaaaggccttatctccatctattgagataattatgtggtttttgtcattcgatctgtttatgtgatggattacatttattaatttgcatatgttgaaccagccttgcatcccagggatgaagctgacttgatcgtggtggataagctttttgatgtgctgctggatccagtttgcccgtattttattgaggatttttacgtcgatgttcatcagggatattggcctaaaattctctttttttgttgtgtctctgccaggctttggtgtcaggatgatgctagcctcatgaaatgaattagggaggattccctctttttctattgattggaatagtttcagaaggaatggtgtccattcctctttgtacctctggtagaattcggctgtgaatctgtctggtcctggactctttttggttggtaggctattaattattgcctcaatttcagaacctgttatttgtctattcagagattcaacttcttcctggtttagtcttggggggtgtatgtgtccaggaatttatccatttcttccagattttctagtttatttgcgtagaggtacttatagtattctctgatggtagtttgtatttttgtgggatcggtggtgatatcccctttattattttttattgcatttatttgagtcttctctttttcttctttattagtcttcctagcgatctattttgttgatcttttcaaaaaaccagctcctggattcattgattttttgaagggttttttgtgtctctatctctttcagttctgctctgatctcattcttttcctgtcttctgctagcttttgaatttgtttgctcttgcttctctaggtcttttaattgtgaggttagggtgtcgatttttgatctctcctgctttctcttgtgggcatttagtgctataaattttcctctacataatgctttaaatgtgtcccagagattctggtacattgtgtctttgttctcattggtttcaaagaacatctttatttctgccttcatttcgttatgtatccagtagtcactcaggagcaggttgttcagtttccatgtagttgtgcagttttgagtgagtttcttaattctgagttctagtttgattgcacagtggtctgagagacagtttattgtgatttctgttcttttacatttgctgaggtgtgttttacttccaaatatgtggtcaattttagaataagtgcgatgtggtgctgagaagaatgtatattctgttgatttggggtggagagttctgtatatgtctattaggtctgcttggtccagagctgagttcaagtattggatatccttgttaagtttctgtcccattggtgtgtctaatattgacagtggggtgttaaagtctcccattattattgtttgggagtctgggtctctttttaggtctctaagaatttgctttatgaatctgggtgctcctgtattgggtgcatatatatttaggatagttagctctttttgttgaattgatccctttaccattatgtaatgaccctctttgtctctttcgatctttgttggtttaaagtctgttttatcagagaccagtattgcaacccctgcattttttttttttttgctttccatttgcttggtagatcttcctccatccctttattttgagcctatgtgtgtcttgcacatgagatgggtctcctgaatacagcacactgatgggtcttgactctttatccaatttgcttgtcagtgtcttttgattgggacatttagtccatttacatttaagtttaatattgttatatgtgaatttgatcctgtcattatggtgctagctggttatttcaccgattaattgatgcaaacagtttcttcatagtgtcgatggtctttacagtttggcatgtttttgcagtggctaccggttgttcctttccatgtttagtgcttccttcaggagctcttgtagggcaggcctggtggtgacaaaatctctcagcattttcttgtctgtaagggattttatatcttcttcacttatgaagcttattttggctggatatgaaattctgggttgaaaattcttttctatgagattgttgaatatttgcccccaatctcttctggcttgtagggtttctgcagagagatcagctgttagtctgatgggctttcctttgtgggtaacccagcctttctctctgactgcccttaacattttttccttcatttcaaccttggtgaatctgacaattatgtgtcttggggtttctcttcttgagaattatctttgtggtgttctctgtgtttcctgaatttggatgttggcctgccttgctaggttggggaagttctcttggataatatcctgaagagcgttttctaagttgggtccattctccccgtcacttttaggtacaccaatcaaacatagatttggtcttttcacatagtcccatatttcctggaggctttgttatttgttttcactgtgttgtctctaatcttgtcttcttgctttatttcattaatttgattttcaatcactgatatcctttcttttgcttgatcaaatcagctactgaagcttgtgcatgcttcacaaagttctcgtactgtggttttcagctccatcaggtaatttaaggtcttctctacactgtttattctagttagccatttgtctaaccttttttcaaggtttttagctgccttgtgatgggttagaacatgctcctttagcttggagaagtttgttattaccgaccttctgaagtccaattctgtcaacatgtcaaactcattctccatccagttttgttcccttgctgtcgaggagtcgttttcctttggaggagaaaaggcattctggtttttggaattttcagcctttttgctctggtttcttcccatctttgtagttttatctacctttggtctttggtgttggtgacctatggatgggcttttggtgtggatgtcctttttgttgatgttgatgatattactttctgtttgttaggtttctgtttgttaggacagactgtcccctcagctgcatgtctgttggagtttgctgcaggtccactccagaccctgttttcctgggtatcaccagtggaggctgcagaacagcaaatattgctgcctgatccttcctctagaagcttcatcccagagggacacctgcctgtatgaggtatctgttggcccctactggtaggtgtctcccagtcaggctacatgggggtcagggacccacttgaggaagcagtctgtccattatcagagctcgaatgccatgctgggagaaccactgctctcttcagagctgacaggcagggacatttaagtctggagaagctgtctgctgtcttttgttcagatatgccctgccgccagaggttgaaaatagagaggcaatacgccttgctgagctgcagtgggctccgcccagttcaagcttccctgctgctttgtttacattgtgaacatagaaccacctacttaagcctcagcaatggcagacgccccttccccaccttgctccagcatcccaggtccatctcagacttctgcactagcagtgagcaaggctctgtgggcatgggacctgccaagccaggcacaggagggaatctcctggtctgccggttgcgaagaccatggggaaagtgcagtatttgggcaggagtgtaccgctcctccaggtacagtcactcacagcttcctttgactaggaaagggaaatcctctgatcccttgtgcttcccgggtgaggcaatgccccgccctacttcagctcaccctctgtgggctacacccactgtccaaccagactcaatgagatgaaccaggtaactcagttggaaatgcagaaatcaccgatcttctgcatcaatctccctgggagctgcagatcggagctgttcctgtttggccttcttggaagcaaccccctagttctcatttttttttgttttattgcattggcccaaactttcattataatgtggaataattataaattattaattttataattagtttataattttcttagtgactgtaataataatgcccttgccatttgtttgctaataccttagagtcatcctttcttctctttctctttataattcacattcagtctatcagcaaacccaattagaaataccttcaaaatatatgctggctccagttactttgcaatgtctttatcactactccttaatcaagtcactgtaatttcttttttttttattatactttaagttttagggtacatgtgcacagtgtgcaggtttgttacatatgtatacatgtgcattttggtgtgttgcatctgttaactcgtgatttacattaggtatatctcctaatgctatccctccctgctccccccaccccacaacaggccccagtgtgtggtgttccccaccgtgtttccaagtgttcttattgttcagttcccacctatgagtgagaacatgtggtgtttggttttctgtccttgcgatagtttgctcagaatgatggtttctagcttcatccatgtccctgcaaaggacatgaactcatcctttttatggctgcatagtattgcatcgtatatatgtgccacattttcttaatccagtctatcattgatggacatgtgggttggttccaagtctttgctattgtgaatagtgccgcaataaacatatgtgtgcgtgtgtctttatagcagcatgatttataatcctttgggtatatacccagtaatgggatggctgggccaaatggtatttctagttctagatcctcgaggaattgccatactgtcttccacaatagttgaactagtttacagtcccaccaacagtgtaaaagtgttcctatttctccacatcctctccagcacctgttgtttcctgactttttaatgatcaccattctaactggtgtaagatggtatctcactgtggttttgatttgcatttctctgatggccagtgatgatgagcattttttcatgtgtcttttggctgcataaatgtcttcttttgagaagtgtctgttcatatcctttgcccactttttgatgggggtgtttgaattattcttgtaaatttgtttgagttcattgtagattctggatattagccctttgtcagatgggtagattgtaaaaattttctcctattctgtaggttgcctgttcactctgatagtagttccttttgctgtgcagaagctctttagcttaattagaccccatttgtcaattttggcttttgttgccattgcatttggtgttttagtcaagaagtccttgcccatgcctatggcctgaatggtattgcctaggttttcttctaggatttttatggttttaggtctaatatttaagtctttaatccatcttgaattaatttttgtataaggtgtaaggaagggatccagtttcagctttctacatatggctagccagttttcccatcaccattaattaaataggtaattctttccccatttcttgtttttgtctggtttgtcaaagatcagatagttgtagatgtgtggtatcatttctgagggctctattctgttccattaagtcaccgtaatttcttacctgacactgcagtagcctggtaatggtctatctacatttaccctttcttctatacaatctgttgcccctaaacactcagagtgacccttttaaatgttaagtcagatcttattaattccatggttcaagctttccagggggttataatcacttttaaaataaaatctaaattctgtgaggttctgtatgatctgactctccagccttgtttcctaaaactcttgcctgtccttgttctgttctcattcttgccaacctgacctttttctttttccttgagcacactaacccttcttttgccgttatatttgatattttcctctttagagaataccctacaccccatatagtcctatgcctccttccttatttcattcaggtcagtgctcaaatacctccttagagaagtattttctgaccacttgtgtacctcatccattgctctttgtccttctactcaggttttgccttcctaacaaggaaatatgcttaacattatattgtataatgcatttatttgtttgctgtgtgtttctgccattaaaatgtgagctctttgagtgtttgtttgtattttgcaggtttctttatccctgatgaatatgtcagcatctaaaacatgggatattcaatatatactatttttaggatgaataaataaatggctatagtacttgccaaatgtccctcatggaaagttacacttaaattggcattttaaagactgagaaatctggcaattatattaaattttgttgaaggcctttgtgtttcacatgattatttgagtgtggcaaacttttttccaagacatttatattaagaccttgtagaatcttgttatggttctgtttaactgttgaacctaggcttggtaggaactgcttccattttctcctttctctcttgtcaatctctgtctctctctctctctctccccgcccctccatctctgtgtgtgtgtgtgtgtgtgtgtttatgtgtgcatttgtgtgtatgatatcctagtcagattttgcagcaaaggtacttctagctttaagattaaataatttttaagcatatactatgacctgaagcaggtaaaattttaaaataagataataaattatgtccttgaaggcttgagtcaaatttaaagtaactggatctggtgtctatggtcaaggttgtaattctgataattttctgtgttttttttctagggtctattaatatttcatatttctttgtaaatacttaaatttaaatatttttctggaaagtcacccattactttggattatctagttagggtgctatagtttttatataattttcattctcattttaaaacacttgtatgtaaatgcttttgtgatgccattctcatgactaatatttatgtatttgtgtcttcttgtatatatccatattttggccctttggcagacttaccagagttttagtactgtatcagtctctatcactaggtttcattttttatttattaattcaactatttatttcttttggggatagatttgtttctaatttctttctttctcgtttcacataatctaatcattcctttgtatggggaattcatttttactttggttgaattatagcaaaaaacaaaggaatctaggcatctatgttttagaatgtattgaaatttccatgtgatggaacatgacctattttgtaaatattgattttatagatgttgcagagaacttaaagatcacattttatttctatttataatcaagctagacattatgaatgtctttttaagtttttgctattactttaaattagtaatacaatcatatttattgtcttttatttataacaattttttacttatatatttttatgcaatgtgaactaaaatgtaaagatttatggctgttgcatcaacttcgtgagatttatgtgcatctgtgatcatgattgaggctggcctacatttgtgtcctttttatactgcttttgttggtttttggtaacaaggttatgttggtatcataaaataaggaaagatcagagagagctctgtcttctttttcctgttctctagaaggctttgtgtaacattggatttttaaaaatatctttgatagaaccttctggagaagctgtatgaagtcatagttttctttgtgggaaaggttttattgcattcaattaatgaattcaattccatttctaactgtactttcttaaataaatgtttatacttgctctggcttccaaaatcactgtcaaggtatcagttatagtctgtgctactcctatgaatttaatctgctcctctgctgcatttaagattttgttattgtcttttcttttctgcagctccactatcatgtgaatttgtttttattcattctgcaagtgcttttttagaactgttgaataggtactggtttctttcatcaatctgagttcaaatatcagttctcttaaacattgcttctgcctcatttttctttcctttcctttccttctgaaactcaaatttaatgtacattgggctgtgtcttttgatgtctgttatcctctcccatgtgtgtcccatatttttgtttcatcatgcttcattccacatgggttcttctgataaatcatctagtttattaattttctcttgaccggtgttaaacccatctattgagtgttaaatttttattattctatttttcagttctattatttctagttcattagtttttgaatcttcagtatcacattttactttttccacatttgctataatcttaaattcagcttatatttcattggttgtaataactataactgcagtagtttctacatttgatggtttgcaaatatagattttctgtgtttctgtttctattgacaattgttggtactgattttgactattgtcatctttgtatgtctcttattgtccttatagtctttcgttgttgcctaaacattttgagaaattatttgtaggaaataatttgggacttggaatataccttcttccagatatttggaagaagcttgaatgacaggttagatcatttgaaaaagaaattttattttttgtattccaggtacctgggagtgaaagcagtctcaaattaaggcttgaggactttctgagctacctagatgatctgccaaaatacctcagtttaagagtacaactcctgagcgtccctaccacattagagtatacattaccttaggtttttacctttgtcacgcattacattctgacttgtccttccagctcctgaaatttacccaagaggtcagcttgccttcaagccatttccacaagaataggcactttggccagagtaagaatgacatccaggaagaggggatattcttcaggttctctgtttctggtgacttcaggaccttgaacctcacaccttttcactttaaagaactccacccctctcaggtgctttttctacaaaggcaattattccctgaacaggagggctctagttcatctctttttgttctattctcttagcaagaaattccctaatatcttaggtcttggatgttaagtaaatcttttctgacttttaatcgagttttttagtcatcttcagcaaaagggttagtgcaaatcacctagtatgccattatcagagtgaaagcctgtgtgtatgaatatgcatgtttgtgtgaataataattggatttttaaaaaatttctgttttagtaggagctgtttctttggttatgcaacttgctattctctttctaaattgtgagttttcatcttatgtctgtaatttttcattggctactcacataacaaactaatccagatagttgagtacaggtaaaagatcatctccattttttctttttttgtttttgagatggagtcttgctctgttgccaggctggagtgcagtggcacagtcttggctcactgcaatctttgactccgtggttcaagtgattctcctgcctcagcctccccagtagctggaattaaaggaatgcgccaccatacccagctaatttttgtccttttttagtagagacggggtttcaccatgttggccaggatggtcttgatctcctgacctggtgatccacccgccttagcctcccaaagtgctaggattacaggcgtcagccaccgcgcctagccgatcatctccatttctgatcttgttgaccttcaccactgtacgggtgaaatcttcctgtgtgtaccagatgaaaacagacaaactttccagcctctagagctgtgaaaaaaataaatttctgttgtttaagctacccagtctgtaggattttgttatggtaccttgggcagagtaagttggcaggctgggcgcggtggctcatgcctgtaatcccaggactttgggaggctgaggcgggcggatcacgaggtcaggagatcgagaccatcttggctaacacagtgaaaccccgtctctactaaaaaatgtaaaaaaattagccgggtgtggtggcgggtgcctgtagtcccagctactggggaggctgaggcaggaaaatggtgtgaacccaggagacagagcttgcagtgagctgagatcatgccactgcactccagcctggtgacacagcgagactccatctccaaaaaaaaaaaaaaaaaaaaaaagagagacagttggcaaaaatatatcggtaattccaagtaggggagaaaaatatgaagaaacacatggaggaaagaatgagtgcagtctgtgagggtgtgtgcaagtggtttaataatgttagaacataaaatcaagactgtgataaatgaggaagaatggcagaaatgggaaataaggataagtaaatcaagccatttcttggaaatccttaagtgccataccaaggaacctggattgtctcctaaaattatagatcagaattaagtagcaaattcgcaaggtggtatttgtagagcttttaaaattttatttttattcaataattgcagattatatgaataattaatttgatgtgaatatacattgagtgtgggcagatcagtaggaagctgtttcagtcctccaggtaacagatgatgatgctttaaactgctactgtagagttgaagatggaaaatgctgaaatggatctaaaaattcttgtgtatgtaaaataactcaatattctccttgaggtgaaattgcagataaagagagatataaagaattagctgcagacagaaatggatccagatttttaaggttctgaggcacctacaatttgggaagctttttttttttttttttctctgacggagtttcacccttgttgcccaggctggagtgcaatggcatgatctcgactcacagcaacctcctcgtcctgggttcaagcgattatcctgtctcagcctcctgagtagctgggattacaggcatgtgccaccatgcctggctaattttgtatttttagtagagacagggtttctccacatacaaaagtataaaataaaaacgtcctagtctccttcctaatttagcttcaggaaggagaagccacctccactggctggatttaagtttgaatgacagggtagatcaggagccaccaatgcagctaaaaattatatgggaagggcaggattagagaagaaggtgatgggtttagttttgaacatgcccttggtatcagagaagcagttagagatgtttgaaaggatgctcaacatgttagtctgaagcttttgaaatctgaatttcaagaataaatatgttcatttacgagtcatcaaagaaaaagtagaagttgaaaccaagaaaaataattcgatcatccagagaagttaagaagaatgttaaaaaaaagaggggcaagtatgaaaatctgaggaaaactaatgttttagtgtaggctgggaccagtgcaagaacagttaaccttatagttccacattttatgtatatcataaaggcctaaaccacagcagtggcaaagagaagggagaagaggggagttgtttctgagattttagttgactaacaagactaggagaacaattttctatgaagggatgaatgaaaagagtgaaataaagatgacaatgagtttctagtacagagagaaaaatgagtgtttagataaaattgcttggacaaaatagtgaatagataaaatttccatttactgatatagaaagtcagacagaagaagagatttaggaagaaatggttaatttgaactgcctttagactatcatgacggaagtgtctattaagcagttagaaatagatccagcaattatagattttgaagtagatattatctttctctttatattccaatgtaaagaaaaacatgagtagaaaaaatgttatatcacttgtctagaattatacagtaactgatgctcctacagttagtaagctcagaatcgtcagccagtcagtattatatgcagaagacgcccatggacagaaccctggagaataccaaggaccaaaagagtagagggtgaaaagctagtttaaaagcaattgttccaaccattgtggaagacagtgtggtaattcctcaaggatctagaaacagaaataccatttgacccagcaatcccattactgggtgaatacccaaaggattgtaaatcattctactataaagacacatgcacacatgtttattatagcactatttacaatagcaaagacttggaaccaacccaaatgcccatcaatgatagactgggtaaagaaaatgtggcacatatacaccaaggaatactatgcagccatagaaaaggatgagttcatgtcctttgcagggacatggatgaagctggaaaccgtcatcctcagcaaactaacacaggaacagaaaaccaaacatcacatgttctcactggtaagtgggagttgaacaaggagaacacatggacacatggaggggaacaacacacattggggcctgtcgggggatggggggcaaggggagggatagcattaggacaaatacctaatgcatgtggggcttaaaacctagatgacgggttgatgggtgcagtaaaccgccatggcacatgtatacctatgtaacctgcactttctgcacgtgtgtctcagaacttaaataaaaaaaaaaaagaagaagaatactcagagagtaggatgctttctaactagatagggttgatggtaaactacaaaacttttagacatcatcaacaagttttcctatgctgtgttttattgtgttttagtttttctcatttgatgtagatgattattttatttctaaattgaagttttctttttctctaagtaatggtgcacagagattaaaggtaaaatcatactatcaatacataaataaataaatgcaattgttcttcactatcctcttccactactcgctggcacccagtaacctgctttctgtcattctggatatttcatacaaatgatgttatacaacgtgtgctcttttgtgtctggcttccattacttagcataaggttttcaaggttcatccaagtgagagcatatatcagtacttcattcctttttatggagtgaataacatttccttctgtgtatataccacaatttgtttaacatttgggttgtttctacatttttgctattgcagatagtcctgttgtaaacaagtgtttacatgtaattgtttgaataccacttttcaattatttttaagtatatactcagtagtggaattgctaggtcatgtggaaattctgtgttaaactttttgggattcaccaaactgttttccacagaccaattttacattcccatcagtaacatatgagggtttcaatgtcttgacatctttgccattactttatatatatatatacacacacacacacacacacacacacacacatacacatagataatattttttgatagccacacttgttggtgtaaggtggtatgtcattgtggttttgatttgcatttctctagtgactaataatattatgcatattttcatgtgcttgttgtcaatcgtatattttctttggagaaatgtctactcaagcccttagttcattttttaattgcattgtctttttgttattgagttgtaagtatctttatattctagagaataaacccttgttagatatatgatttgcaaatattttcacgcatcctgtaggttgtcttttcaccttcttaataatgtccattgacacacaagactttttaaatttgatgaagttcagcttatttttttttcattgcttatgcttttggtgtcctatctaagaatgtattgccaaaacccagatttaaccctatatttttttctaagagttttatgctttttgccccttgctttgctcattgacccatcttgcgttaatttgtgcagatggcgtagaggcacaacttcattcccttgaacgtggatatacagttttaccagcaccatttgttgggaagattaatcttttcccccatcaaatggtcttagcgcccttgttgaaaatgtattagtaatagaagtatgggtttatttctgaactcttagttctgtttcactggtctgtatgtttatccttatgccagtaccacgctgtttggattgccataactttatgttttgaaatcacaagtacaggtcctccaattttgttctttttcaagatcattttggctgtttgaccagtttcaagattgtttagcttgcagttccatatgaattttagaatcaacttttttttttttttttttgagacagagtctcactcactttgtggcccaagcatggagtacagtggggcaatctctctgctcactgttacctccacctcgcagattcaagtgattctcctaccttagcctcccaagtatctgggattacaggcgtgcaccaccatgcctgggtaacttttgtatttttagtctaaatggggtttcaccatgttggccagggtggtctcaaactcctgacctcaagtgatctgcccgccttggcctttcaaagtgctgggattgcaggagtaagccaccgcacctggcctgaatcaacttttctatttctgagaaaaggactgatgaaattttgatagaattgcattgaatctttaaactgctttggctagtattgccatcttaacagaattaatagtaaatcattaacatgggaagttttccatttatttaggtcttttaaaatttccttcagcaatgtcctacaattttcagtgtacaagtctttcattttcttggttaaattcatttctaggcattttattcttttgggtactattgtaaatagaattatttttcagacttccttttttggattatttattgctggcataaaaaacacaactgtactgtgttttgctcttgtaccctgcaactttgctgaattagtttattattcttaaaggatattggcctgtagtcttctcttcttgtggtgtctttatctggccttggtattggtgtggcctcatagaatgagttagaatatgttccctcttattctgttaatttggaatagtttgagaaagattgatgttaaatcttttttatatgtttggtggaattcacgtgaaatctggtgctggacttttctttatgaggatgttggttactgattaaatatctagttgttataggtgttttcagattctctatttattctcaaatcagttttagtaatttgtatatttccatgaatttatattcatataggttagtatatagaatttgttggcatataattacttatagtattataatcctttttattcctataaggtcagtagttatgtccccagctttcatttctgaatttagttatttgcatcttccctctttttttcttagtctagctaaagctttatcaatttcattgatttttttaaaggaacaacttttgtttcatttattttcttcattatttttcttgtcactattctctaatttttattattactttcttcctgttagctttgtcttcagtctgctcttcattttctagttccttaaggtggtaagttagattattgatttgtgatgttgaaccagccttgcatagaaatagaggcatttatgagctataaatttacctctgaacaccgcttttactgtattccctaagtttctttaatgctatgtttttgtttacttttatctctaaatatcttctaatcctccttgtggtttcttttctagcatattgattgtttcagagtgtgtagtttaatttctacatatttgtgaacttttctattttccttgttactgatttctagcttcatgaagctagaaccatgttttatatggttgcaatccttttaaccttaataaaacttgtttggcggcctgacatatggtctatccaggagaatgtttcatgtacacttgtgtatgtattctgctagaattgtgtttttgtgcatgaaataatgtacatgggattataaaggaagctataataatagaataggaaatctatatgaaatatagttattaaaatattttaaaatgtgtaatatagtaatatatgagcttttttattttattttattattattatactttaagttttagggtacatgtgcacaatgtgcaggtttgttaaatatatatacatgtgccatgttggtgtgctgcacccattaactcatcatttagcattaggtttatctcctaatgctatccctcccccctctcctcaccccacaacagtccctggagtgcgatgttccccttcctatgtccatgtgttctcatcgttcaatttccacctatgagtgagaacaggcagtgttcggttttttgtccttgcaatagtttgctgagaatgatggtttccaatttcatccatgtccctacaaaggacatgaacttgtcattttttatggctgcatagtatgccatggtgtatatgtgccacattttcctaatccagtctatcattgttggacatttgggttggttccaagtcttttgctattgtgaatagtgctgcaataaacatacatgtgcatgtgtctttatagcagcatgatttataatcctttgggtatatacccagtaatgggatggctaggtcaaatggtatttctagttctagatccctgaggaatcaccacaccgacttccataatggttgaactagtttagtgtcccaccaacagtgtaaaagtgttcctatttctccacatcctctccagcacctattgtttcctgactttttaatgattgccattctaactggtgtgagatggtatctcattgtggttttgatttgcatttgtctgatggccagtgatgatgagcattttttcatgtgttttttggctgcataaatgtcttcttttgagaagtgtctgttcatatccttcacccactttttgatggggttgtttgtttgtttcttgtaaatttgttggagttcattgtagattctggatattagccctttgtcagatgagtagattgcaaaaattttctcccattctgtaggttgcctgttcactctgatggcagtttcttttgctgtgcagaagctctttagtttaattagatcccatttgtcaattttggctttcgttgcctttgcttttcgtgttttagacatgaagtccttgtccatgcctatggcctgaatggcattgcctaggttttcttctagggtttttatgggtttaggtctagcatgtaagtctttaatccatcttgaattaatttttgtataaggtgtaaggaagggatccagtttcagctttctacatatggctagccagttttcccagcaccatttgttaaatagggaatcctttccccattgcttgtttttgccaggtttgtcaaagatcagatagttgtagatatgtggcattatttctgagggctctgttctgttccattggtctatatctctgttttggtaccagtaccatgctattttggttactgtagccttgtagtatagtttgaagtcaggtagcgtgatgcttccagctttgttcttttggcttaggattgacttggtgacgcgggctcttttttggttccatatgaagtttaaagtagttttttccaattctgggaagaaagtcattgatagcttgatggggatggcattgaatctataaattaccttggcagtatggccattttcacgatattgattcttcctacccatgagcatggaatattcttacatttgtttgtatcctcttttaattcattgagcagtggtttgtagttctccttgaagaggtccttcacatcccttgtaagttggattcctaggtattttattttctttgaagcaattgtgaatgggagtttactcatgatttggctctctgtttgtctgttattggtgcataagaatgcttgtaatttttgcacattgattttgtatcctgagactttgctgaagttgcttatcagcttatggagattttgggctgagacaatggggttttctagatatacaatcatgtcatctgcaaacagggacaatttgacttcctcttttcctaattgtataccctttatttccttctcctgcctgactgccctggccagcactttcaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagggttgttgaattttgtcaaaggccatttctgcatctattgagataatcatgtggtttttgtctttggttctgtttatatgctggattacatttattgattttcatatgttgaaccagccttgcatcccagggatgacgcccacttgatcatggtggataaggtttttgatgtgctgctggattcagtttgccagtattttattgaggatttttgcatcaatgttcttcaaggatatcggtctaaaattctctttttttgttgtgtctctgcgaggctttggtatcaggatgatgctggcctcataaaatgcgttagggaggattccctctttttctattgattgggagagtttcagaaggaatggtaccagttcctccttttacctctggtagaattcggctgtgaatccatctggtcctggactctttttggttggtaagctattgattattgccacaatttcagagcctgttattggtctattcagagattcaacttcttcctggttcagtcttgggagggtgtatgtgtggaggaatttatccatttcttctagattttctagtttatttgcgtagagttgtttgtagtattctccgatggtagtttgtatttctgtgggatcggtggtgatatcccctttatcatttttcattgcgtctatttgattcttctctctttttttctttattagtcttgctagcggtctatcaattttgttgatcttttcaaaaaaacagctcctggatgcattaattttttgaagggttttttgtgtctctatttccttcagttctgctccgattttagttatttcttgccttctgctagtttttgaatgtgtttgctcttgcttttctagttcttttaattgtgatgttagggtgtcaattttggatctttcctgctttctcttgtgggcatttagtgctagaaatttccctctacacactgctttgaatgtgtcccagagattctggtatgttgtgtctttgttctcgttggtttcaaagaacatctttatttctgccttcatttccttatgtacccagtagtcattcaggagcaggttgttcagtttccatgtagttgagcggttttgagtgagtttcttaattctgagttctagtttgattgcactgtggtctgagagacagtttgttataatttctgttcttttacatatgctgaggagtgctttacttccaactatgtggtcagttttggaataggtgtggtgtggtgctgaaaagaatgtatattctattgatttggggtggagagttctgtagatgtctattaggtccgcttggtgcagagccgagttcaattcctgggtatccttgttaaatttctgtgtcattgatctgtctaatgttgacagtggggtgttaaagtctcccattattgttgtgtgggactctaaggacttgctttatgaatctgggtgctcctgtattgggtgcatatatatttaggatagttagctcttcttgttgaattgatccctttaccattatgtaatggccttctttgtctcttttgatctttgttgatttaaagtctgttttatcagagactaggattgcaacccctgcctttttttgttttccatttgcttggtagatcttcctccatccctatgattgttcctttggaagttttgtctcagaggagtacctggccgtgtgaggtgtcagtgtgcccctactgaggggtgcctcccagttaggctgctcagggctcagagacccacttgaggaggcagtctgcccattctcagatctccagctgcgtgctgggagaaccgctactctcttcaaagctgtcagacagggacatttaagtctgcagaggttactgctgtctttttgtttgtctgtgccctgcccccagaggtggagcctacagaggcaggaaggcctccttgagctgtgttgggctccacccagttcgagcttccaggctgctttgtttacctcatcgagcctgggcaatggcaggcacccctcccccagcctcgctgccaccttgcagtttgatctcagactgctgtgctagcaatcagcaaaactccatgggcatgggaccctccgagccatgtgcgggatataatctcctggtgtgccattttttaagcctattggaaaagcgcagtattagggtgggagtgaccagattttccaggtgccatctgtcacccctttctttgactaggaaagggaactccctgaccccttgcacttcccaagtgaggcaatgcctcaccctgcttcagctcacgcacgatgcactaaacccactttcctgcacccactgtctggcactccctagtgagatgaacccggtaccttagatggaaatgcagaaatcacccatcttctgtgtcgctcacactgggagctgtagactggagctgttcctatttggccatcttggctccaccacaatatatgagcatttaaattaaaatttgaaataagctaccataatcctaaagtagtaatatggataaataatatttcaagattcctgcataacctaaggtgccatgaaaatatctataatttccgctggtaatagtcataagtactactaatactactgtggtattattggtattaacaaaaataaagatgtgattgttttacccacctaagctcatagatatactgtactctatcctcagattatctggtggtctaaagaacctagattaagagctcttgtttaatgatttgtccttcagtttgaaaaacattgttctaagccatcagataaataaatagtttttctaagttaaaggagggagaatgagtaacctcttatagcctatcagaagtcatctccaccctggaaaagagactgattgtcccctcctggtggcatcttgggcccaaactggtatcaaacaatgtgagttcatcctcatgtctgaagaccatcctgatggaaggaagaagctggaatcttgcctcggctgctgatgtcattgtttatgctaagaatattgctttagggataaacccttaggcattttgtaagactagaagagaaagtctcattgctgaggcttaattagtatttgtgaaacaccaagaggtctctgtagaaatggccttgggtaacagcaaattagtatttttaattattatcattaaaaatgaatatttacaagaaattgggctgaaggccatctggcccaaacacgttcctaagggaggccataagcactaaaggagggaggcaggagcatggtgcagaatggatggaactatttatagcttttcaaggcttttgtttaggtcatcaactagaaagggcatttaaaagttaagctaagcaccaagagacccaatggaaagaataagtaaatattgtttgtttttaatttttgagaaacatcttcatattttgacattaaaatgtgacaatatatatttcttccttttcctcatgtatatattcttcactgtttctcttaattgaaagaaacaaagcaaacatttagtcataattctatttatatgcagccttggcaggtcattttatttcaggggctctgtgtgagtatttcctccttagctacttgcttggtattgtattgatgaaagaattaatatttgaaaggttttgtagtatttgaattcttttaaagtataactaatttgtcatttctgtaattcaatataatgtattaaatataggattgaatattcaggtattaattttactattcagatcatttattttatcaaaattttaaaactgtggctgaatgtggtggcgcctgtaatcctaactactaggaggcagaggtgggaggatcacttaagtccaggagttggaggttacagtgagctgtgattgcaccactgcactgcagcctgggtgatagggcaagtctctgtctctaaaatagagaaataatctttaaaaataatttattaattataaaatataaaagcaaatcaaagttttgttgattcaatatattaatgaaatgatatattgaatattgctctttattcagagaaaagaatatgtgctacttgatgacagtgacagttcagtgaaagaggcatctctcctactttacattaggtatgtaaattggtacatcatctttgaaaagtaatttgcaatataactcaagggctttaaaatagtcataccactaaacttcataatactgcttctgagaatgtatccctccaaaaactctaaatacagaaaaatccttctttgcaaatatatttactacagcattatttattaaataaaagagtgaaacaatctaagtatttcataatagaggtctggttatataaaggatataatattgatttagacattaaaataatatgttatcagagttttaataacatgaaaaatattcaagaaattatgtattacataacaagtttacagtatataacaaggcttgtaacacagtggtaaaagcgtaagtttcttagctgtgtccttggtcagattatttcccctgtgtctcagtttccttatacgtgaaatggaaatgatattccattccctgaaagaaaatggaaaaataaataaatataaaatggaaatgatggactgtaaaatgacagtacttactttgtataattaccatgaaaattaggagttagtgtatgtcaattgcttaaaaggtacctgatactaagtaagtgctccgtagatgctagatgctgttattatcatcatctactgcagggttgtcacaacaggctcaggaaaagaaaccagcagacactggcaaagaatacacgttctttaatgtagacaaaagatgccacttactgcacagagatggttctgctaggaaagggacacagaagtactctcagttggaggaccaagcttctagtgccttctccctccacaggggaaccctgctccgtagatgccacagatagtgtgaagaaccaccaggtcattcagcagcctggtgaaccctcctggcacctcccggctcttctcctcactcagccagggcctgctggctcaccagttgcaacactggtggcaatcccagcataccctaagtgatcaccaggagatgaaaaaccaaatttaggtcagttttccagactttagggttttggagtttatccctacaattgcttgttaggtgaaaaaaacaggatccaaaattaggatataaaatatcatcacaaatattctataagaaataatcctgaatagaaaccaagaatcaaattaaggaagccaaaatatacccagatgttgctttggggtagtaaaaccatgggtgattaattttgttctttttcaaattttctgttttccaaaattctataattcaaattcactattttataaacaaaaatgtaaactaacaagtaataatggtggtgaggattttctacatcatgtgtgatcgctctctttttttggcttcacttcagatatagtgtttttcatggggaatctctgtaacaggctggtaagatacagccaaggcaaatttgatcactatcagtataaattaggaaatgcagttgaaactatcagaaacacctgattaaacctgaataacaaatagaatttattagtaattaacccagtattggggctgttttcagggtgaaggttaattcaacagtataataatgtcagtaagaaaccctttctcccccaccctccctccctccttttctttcttccttcctcttattctttctttctttctttggttttcttgttctttccatctctgcatctgtaaggttggttttatcctaaggctgcctcctctatgtttgtcagcagcaccaaggctacaggtcttctcattcacacatacacaaatatcctgttgggagcaacttaggtccgatggtcattcctgaatcaattactttggctcagagaatgccatacactaatggcttaggcttgaatttcaggctcatttctgaatccattactgtactaaaagaggtaggattttccttatcagtgctgagtgtagccccatttctaaatgtttaaaaacaataaacaaatataaaaggtaaagagcttaaacacaattctcagagttctctttttcccttttcctccttctgctcttccttgggattcagtttctttctggggggataggtactaatgtatactgctatcctctggaaaggatgtaacatctgtgtcatctgtgctcactgacctccatacagacacagcctatcccatctagtcccatctctgggcactggcaaccactgcttatagctctagtctcacccagtgcctccagccatgtggtccttgtaatctgttgcaacttcaggtcctttgagtcttccagtttatcctcagccacttctgtgctcctttgaggaggccatggcaacccagttaggttctgtgggactttgtgaagatatctccaggtctatctacccagtcatctaccaccctcagtcattactccctacacacagggtcatgttgaaaataacttccagtatcagatgctggttacctgtttattcagaagtcatctccaacctggaaaagagactttctggggctatgccccagaaagcctggtggtgattcttccaaaaatggtgtttttttttccactcctcccagatactcagccctcctaccctcttcatagtcagacgctcctttcccttcttacaaaaccatgaattctctaatattttatttttgggaaaactgtatgacctcttccttcaggttttggctcttggtttccaagccaagttttgaaaattccccaaattctcacctctttcataaaagtgactttcaagattattgcctctactatatgtttttaaaagtctgctttggagttaaaagcatggaaatcaactctttgttctcagtgagtgcttttctgtttttttctttccagggacaacagtctcagcctccagaccttgttttaattacagaacggctttagagtgaaatcataattaaagcaattacattggagaatatttcaaaacattgtcttgctaccataataaatgtcaagaatgatgcagacattaaacactatagagatctaaggaaaagatagattaagttatagcaatggaagatcagatatgattcataaatgtagtgagaccagataattcttaaagaataagtagaagtttgataagaagaagaaaaggaaaagagaaatggagttgttctcagttatttgcttttgttgtaatggattatattgtagaatattttctctgatgagctgctcctttagcaaagctctgacaggagtgtatccacatatttttaaagaataaatgttgattacaaatatcatttcccttaagagggtacttcatgtaattctcatcaacttcagaaaatactttaaaagcacatattttctgctctaaggtcaatgaactgtcctgaattttagcgctatcccacatgactgtgttggactggatcagtgcctctcaaaatgggggatcacaagagttttatttaattttcctttagatcatggtgtaaaaatacaagcgaaagctgaaatttattatttttagtaataacttttttggaaaatcttttccgaaaagtaaagtttcctttattaaatattttttttttaattttactttgttttctaactgggacctatagactgttcttgagagtccttacattactatgtaaataacgtctccaatagcactgttttcttccaggagtgattcttgctgattcctaaagtttgaattgcagatttactgtttattagctctgtaaccttggacttttatttaatctttgtctttgtatccttttctgtaaaaggggaatgaaaaactttatctcactatgtcttgtgaggattaaataaagaaaattaattaaaacctgatagctaccttcattctggttagaattattatttgataacataaatgtccatattgtcatttctgtcatcgcatgcctcccgagcgcatgtttcttgggtcttttctctgtatacaaaaagctctcttgtaatctatttctgccctaatgctggtgccatgaaacacccttttagtgtctgtatctgggcttgccattctccccttctccctggtagtcacctttccaggaggtgggaactgtttccagctacccactcatatctgcactgaggctcggggaacaagccagcgtgggagccaaactaatataacttgccccattggctccagacagcacttctgccagacaggagtctgagtcctgggtagccttttggctgaggagttattcaataaaaacttacagaagactgtaggattagtctactcagcactggacagatttgagcccatagagtaagacaggttttatgctgtggcaaaactacatttgcttatttgactaaagcagtgtaacagctgaggtttgttaagtgaccaggaaatgtaaaacactttacttatgttatctctaataccccttcaaaaaaaatccttgcgagatatgaattactatccttattttagatttgaaaatgctgatgcttggcattcaatggcaccaaacaaaactactgtccgtatctgtcaaacttgaggaatagtctatttctaccattttgttctaccttcctaaaaactggaaagtatctattagaactacttcagatagagggtaggctgctgatcaaaagtactcttagctgggttgctgatctcacctaccttatccttctttttgtactgttgaacttagaatcatgcttgactttgcatagttactaacagtacatttgtaaataatttatgtttccacctacaagataaattccttggggattgaggtcttgtgtatatttctaccgtggctagcacaatacaatgaacatttatttgttcattccaaagacatttatttaggacctactatattcaaggtattgtattagatagatgctactgcagacaaaatataaaggcacaaggtatctaatcataaggaaattctccatctagtaggagagctacctggaataacagttataatggaagaaactgaagaaaatgataggtattagggttttggaagtaattagaaaaatgacaatgggtggttggcaaaagaaagaaaggcaaaataaagagcaaaattttattttatttaacactgcatccctcttagagaaataaaaattaaaggagatttttcctaggtcttgtgattctacccttgaatttgagagttctgaggcagttagaagtagagcattctggagggtttggtgccttctggcatgagatcattgcaaacagtttacaaccaggcctgggtttagaacaaggtttctctgaagtgcctcaatcatatagctgccataagacggctgaataaagtacccaagcaggtgttactctgcatttcagggccatactggttgtacttaggagagagataacacaagcctctatggaatttcaaatgtgagagagaaaacttctggttggaaaggaccagaagaggctccatagacaggaatatgcaggcagatagaacaatcttagcaaagcccagaggcagtaaacttcgatatacgtcgatgtactgaaaacattttgccaggaagacaattcaatttggcattctggccattgagcaagttgactttggaaaattggcctgcttctgaaagcagggataaatatacgtcttgggacaaatataaaaagggagaagaaatcagtataccatatttattgctttcctacttggtatcagacactctacttcgcgttttatatgtattatttcaccttttcagcaaggctttatgataggtattcattatactaatttttagatgagaaatgctgaacatcacagtcagtgtgtaaaggtgttgcccaagatctcagttacttagctgaagggctgtgattggaacacagatttacttggctttaactctctgtagtttctgctttaatacacagcccaagtttgtgttgaagtaggaagactttatgaagggaaattggtgaaaattggtttataaaggcacgcagaggccagagcttgcacgccaaaccaaagagcttgaacctgacagctcggaaccactgattcactggaagaaagagaatgacagtacattatttgggctttttgaaaataaatcttataatcttgtgcatagggttaaggagactacataaaaactcattgcagtaggtccagtagcaataaaaatatacttaataacttaagttgcaatgcaaatagtagaataaaacagatttgagagaggtagaatggcaagacaatagaaattagggattgataggtggtagggcactagaaaaaggaatgagattgtaatgaaagcataactactgaggaagtttggaagttattatagagtagattcagaaggaaggatgatatatttctgacatatagaatttctggaatcaattctatacacagcagagatgtcctcttggcaggtggaaatttgtgacttgcccttggaaaaagtttgggctgggatataatttaggagtcatttacataaaaagaaattaactgttatatactttattttgaataaaattacttagagagggaaagtgtagttagaaaatagagttagactaagctctgcccactggaagaatttcccttcattactgttctttagggctactcctggtgggagggatatagacagtagcaacctattttcagctagagccaacatagcgggccaacccatctgggaaacaggtttgaggtttttttcctccatcagctggctataagacagtttttacgaggccatagttgtaaattattggaggagagttggtgcaaaaaaggtaggtgtcatgggagtctgggccatcttatcatgcaacttctttaggccttttggccccactcagactaaatgtgaatgtaccatttttgcagtgcagttgattgctactgagcctacccacccttatgatttggcgaatcttataatatccagctcatgatgggaacttggatcacacagtcacttgatggtccatcatcaagtgcttcatcttgaccagggcagactagcgtgctggaagctgtttatcaaatggcaagtagttctctgcctcaaaaggtgtggccttactccagaatcctaagggtctgtgctgcaattctcttctggggctgagactccacatagcatccttagccctaatagtagaactcttgccagaatggcagacagcttgtaccataacctgaacctgaagcagaaccccttcttccatggaaccccctcaaaattgagaacttttcaagtcttcagaaagataggtcagagagattttcccaagtagtgtacatgttaccttcaaaatccaatgatatctaccaagtgctgtgcttgcttttgagtgttaagggttttgagttgcaacactttgtcttctgccttggagaggatgactctgcctgccatttgaccactgggcctctaaagtatttgccaaaataacagattgctgattttttttaagattatatcagtcagcgtctaatcgcaagatggaaaccacacaataatttgaacagggaaagtttaatattagaaattcttaactataataggagactataaagatttaaacagaactctagaggatagcctaacgttgaaggaaaatatgcaagggaaaaataatcgtgtttggtaggggcagggggtagtctcctcagcaaggctgggattcaaattctcagaaaaggtgcagttagttgcagcttcctggatggtaaagaaattcactggtttgcctaggccagagatggcctacgatctctgaacaaacaggagatacctctctggaatgcaggcaggccaaggcaggctggtgggtgggctcacatagagtgttaggctcaggagcctgcttaacatggagtgggggttccttccttgggatgtatgttatctctgtgttggggtaccaagagaaataaacctccaggctgtggatgggtcaagggagtcagggcatcaggagcttgctcaccttcagggtagcacagagcctgaggatctgtatatacatccagagggcctcagccagatggtctctgggccacggctagggctgaggctgcaagttcccaaagggattgtgggtactgggggtgctgctatggcaaggcactgctggatgtccacacatacatacacacacactctcttctgctagttgcacagtaggaacaaaaagaagcaaaacagcagcacaactggaccaggaagagaaacccctttctcctgaaatgtccctccagtgccctctattgacaaagattaacatgctcactgcaaaggagagattcttaaatgtttccagtccactaccagaaaataggtttataggtctaaaagggcagataaagcaatatacttgtaagtgacagagggattaaacactaccctgtggcatgcatattttttattagggtaatttttgttttctgatcatcaggtctaataacatgatgtcatcaactgtagtgaaacagcataatattctttggtatgtcaaggtgatcaaggtttctatagattgcattatgacagagagaagtagagttgtcatagccctggagcaacactgtgaatttgaactggtatctttactgcataaaagcaaactgcttttgatttcctttactgatggtgattaagaaagacacatttgccagctatatagcattcaccagatctgcctgccaagtgccacagtctatgttgatctctccaataaggatagcacattcagcacagcagctgtgactggggctactacttggttaactttataggtgcccactatcatgtatcatgctgtatctggttttgcagaggccaaacagataaattgaattaaagtccctggtagtgatactaatctctgcaattctggaacatgacattgtttctaatttgctatgtaattggaggtggggtggttataaggctctcatttggctctttctacaaaaatgattcatgctttactggtcagagaacaaaagtaagagttctgctagatactaatgatatgtagctcaattatacttttagggaccaggaaaataaccacaggatgggtctgaggacctgatggaaatgtatttagggcagaagtacctttactacccacctttcatcagttcacacttaaattttttttttttcttttttttttttttttttgagaccaagtctcgctctgtcacccaggctggagtgcagtggcacgatctcagctcactgcaacttccgcctcccagattcaagtgactcttctgcctcagcctcctgagaagctggaactacaggcacacaccatcattcccagctaagtttttgtatttttttagtagagacgaggtgttgccatgttagccaggctggtcttgaactcctgacctcaggtgatccacccaccttggcctcccaaagtgctgggattacaggtatgagccactttaataaaggggctttaataaaggggctgtgatcatgttttggttcccctagtatcagtgttagaccctgtgttccatagtccttgcaaagtctatatattatctttgacccagtgcagttatctgtaagtggctttaggtgttttcaagaaaggataataagaatatttatttacacatttatggtgtcattgggttatctcaagttctcccagcctcctcatcagtcagtgggttctcagtctgtgaactaacttagatctggagactgaatgaggaatcctgatttattgcattgcagcaactgacattatcattctgctcaccaactcctggtttaaaagaaataagcaacacactaattatgtatgtttatatatgtattgctcctagtaatgctaggtcctgtgggtctgattgctacgccggtctggccttcttgcctgttctgataattttgtcaacctttcctctgatgcttaaatgccacccaccttacttttgccattctagaatcatagcctcattgatactgtaaaacccagtgccatggtcacatctcttatagtaaactgtgtcctataggagacaactctcactgtggtctcaaagatgtcagtattctcttaccagtgtattcctgattaccttaatgaaaggacaattatctagacctttctggaaatagtcaggggtgagttctctgatcgtatataataaattcattctaacatttctacctcctcaagccatctaccctcagtaatctgccaagacagttttagcatctccaccttatttaatattggccatcattgaggccaagcttcaatgaaccatccagcagcatattaggactggatccatgggtgcctgccaggactttgaacatcagcttaattcctccttatacttcctattcagcttgattcctccccataccccaatcaaaaatcctcatgatccactcctatacataatctactcattcctcctgatacacacacacatacacatatatatgtatatgtgcatatgtcagccagtccctttgttgtataaattatttactcccgagaagaaactatgtttttcctatcaggctttgctgaagtttctcctatctagctcatgtcaatttatcacagctgagaacaattgtgatgccaccacatgctggggattaccaccacccactgaccatcaacaatgggatctgcattgctatttgactggtaggggatctagctccaaaagcccattgtcatatctttgtacagccaatcctgatacctgctgttttatccttggtctcccttaaagtcagcttgagatgaagccttgtataagagcagtttaatttggaagtgattctaaagagtgggaatgaaggagttgggaagtgaagcagagaagaagagagactatacaatattgcattatcaagttggccatgttgcaggtgactgatgcttgatcctgtatttgtcaaaagtagcctcacggtcatttattctcttgaacttctaggttacatatgtgtatcaagcatgttaccacacctcagtatcagagaaccactagaacaggaagcaatagcacacagttcaggttgagatactgtcatagcatgtgtgaagctggccaaagccagtatggaatgggtggtaatggtaatgagtatagtgagagttggagctgaaagatgctaagtgttgcataatagttgtgcaactcaccaagagagcccgcagctaatggctcacaccaggatggatggacagatggatggattaggactaaatgaaaaatttaaaaatccctatttctctgtttcaagtcttgatttataaaaccaaaatattatgctacattattcctttctgaagagaagagtgaaattttgctaataattataatgtatagaaaacttattttcgtgttctaacaactctctgtcaaaggaattggttattgtacagctttatttactccgtgactcaaaattattaaagaaattggaatgtttaattctaacacttgattttggcctgaaggagctgaaaattaaattaatcttactgtctgatttatattcttatcactagtgaactagctgcagatctatttaatttgaagactgttagcaattatatttattcacttatgtctatttgaaagcttgcatattaccttttaaatgcttcatatgggccaacagttttacccaaggcagacaaaattgggacagtatttttcagaggtaaatagcgattcaaaattagattcaaggtccgtaacataactaggctcaattatcaaggccaattccagcattcagctttattgctcacgggaagcaggctcacacaacagcaggttttttagactggattttcctcacaaattatatattaccctgtaagaaaccagcatgtaaattacaaagctcatgccctgagtccaaattgctttgtgtatatggtgagtttaatgtattttcctcaaatattaggagacatgaggcaacaattgtttagatcattcctctataggaaaggcaggcaagtgacactacaggcctgtggatgtaatgaagacaaaggcagataaagtcattaattcatttgtcagagagacccactggggacctatcattcatgccaggctaggtgctaacagggatatggaaagtggggaagaactagctatctaggagagtcaaccataaaacacacagacaggtgtaatatgagtatgatgaatgccatagtggagtgcaaagtgactcctggctcaaagagtgaaaagaaaatatgaacaggtacaggtgtgacattgggaatgggtttacagatagtctagagtccaaactgaaccctgaagggataggttggattttgaaagacgaaaatagaggtggaatggcaacaggtggagagaacaactctgctgtccttcaggtttcaacccaaatgcagtttatttcacaaaagactttccttactcctctcaagttgcaggacctaacccttcttaaaactttttgtgcctcttctctagcacatacaatttactgtcataggttattgttccatgcatatcatagtgcaaattttacaaattcatattctcttcaccttgtgagattctttttcaccagtgaaatccttctttccacctcttgccaaagtgcccttctgtgtttgcataccaacacaagagagaaagaagagagagagggagagaccacgagagagatggagccaccatgatgcacagaaaccacagtgctcccgccccagtactccacatggttaatggagtgaccaacacaaacacaaggctgcctttcagagatgcctttgtgaaagagcaggttagcagtgcagaagtaatacatttaatttccttttctctattgaaaaaaattaaacacattaaagtgaggaccagataaactaaaagtatctgatacttgaataataaacacaggatagctcaatatttgtagaatgtgtcattttcttagaaacacagttctgggggactgtgcaggatccccactgaagtactccaaaggttaattttttttcaaatgaccatttttaaaatatgttcagagaaaactgggaacttatgaacagagagataggacataggaactgtgactgtattagacaggaatatttcgtaatttataagttcttaggaaggtgacacttggtatgaaaatggccagataaaattgcactttcctgtgtattaagcacagttggaagctgagggcaaagtgggccatatgaaatgggagtctgttcaattctgttccatgtgtctagtaaaatgttctgtttttaaaaagcaaaactcatttccctttctctgggagcgagtgtgtaccaggaaatgaggtacagcactatctaaggtacaatatatcatgatgatttgagtttattcatcaaagtctaccctcttttgctgcctcttgacagtttcctgcctcatacaagcctagaaatggacaatttctggtgggagaatctagttttctgcaaatttgggcagtgacttggtgagataagcttatattaacatgaaacctaagtgaactttgtttaagctgaccttgcgtctctttgcatcaagcatgtatatatatatttttaatattaggtgttggtaaatttcctcctaaaaagataatggcactggctcaaagtgacttagtccagacatatttctcatatttgaagaaagaggtaaaaatgtaaataaaatagtctttcatttactgtctcatttgtgttgatgaagctactctttagattctggaaattaaagtgattctactagcaatgactactttataaaataagaagctcaatagtttagtagccacaaccatggatgtggaacctattcagcaaacggctgcatttggcgacttccccttggcagagtctttttcctttatagttggatgaaattataattctccttttaaaaaatgtattttcactgtttttggcaggctccctctctctcagaaaattattctcatgtcatctctttctactttgtgccttgcattgatctgaagatttctcttttcagttgctttggttttatcaagctttttgtgcaggctacctagcacagagctaggtgccatttacctagccatttactagatgctcagtttattactgttgtaactaataaggtctttctgcatagattagagatgaatctttggtttcaatttcagtacattcaatttgggttttcaagttcttgctttgccaccttctgtatttgaaagattggaccagttacaatttctctgagcctcagttcctcatctataaatgagaaaactcatgctatctcatgtggcgccatgaggcctaataaaatgaggaatgcaataatgctttggattctgaaagtgcagtacacacagtagctattaatatggaaagaaaatccaaacctcactatgaattatttacctgttatccacttcttttcatatcagtgaatcagggatctacctctagtgagtggatagaatgaatggaaagaaagctcttagaagacatggtaagagaaatctctctggctttcagagcctcctggtgagtagggccattgtaatgctaattcacaagaggggtgctgccccagctctcttcttgcttcttggcgtgagtttttggaacaatctcttttcttcctgctgctggctttttgaacaggctgtccaggcattttcaatttggcaaccaatgcaataaattacttcttaaaataactcaaatcacttgatttggcttgcccctaagacatttctcctttgattcatcctgtgaaataaaaaaggagatacacacacacacacacacacacacacacacacacacacacacacacacatatatatatatatatatatatatatatatatatatatatatggatccagcctagtccatcttctcttgtacaaacccccatatggtcaagaacccaagtgttgcccttttccagaacagtttactctgcccaaaattcttagcagtaatgtctaagcccttctaagtgttgaatgcaacccctggaaaatttgtatttgcagaggtatgtaagctatccttgtgtaaattcctctaggggttaagccctaatgattgtggaagaaataaaatggaaaaatcagatataactggagaggattgcacttgacataatttcctagcaacctcccagttttcaaggcaatgtttattttatgtgctgcctttcaaagtgatgcctttaatgttattgctatgtaacatggctaattttctcagtaacatatgtagcccaaggaagatctgtgataagactggaaaacacaagttgtcagtaattgcacagtgcctagttaattacattttaagctagaaacacgtttttctcatttgctgtattgctgttatatttataagctaccctgcctctctggaaccttgttttgatctctgtagaaaaaggaatattagtctgagtctctgttatgttttccctttgtttttgttcatttggctcccacttacatggctcctgtactgtacatttagcttcatcattcagacatttattctgaaagccatagatttttcattttcctgtttccatctgctggaacattgaagattgtcacctccttcaaattaaagtagaccttctcattcacaagggaatcttcccaaggtcttcaagaatcctcagttattaacttcaaggaacatttaattcccccctccacacaacagttaactatagctgaaaattttaattgaactcttcagacccttaataattctagatgtacaagcttaagtcatttgtatgtatatagctacagaaacaaagccagcaactaaaataagctcaatcctgtattacattatattcttttgctagtaacttaaatcagcaaaactgctacagtgatgataaaaaggtgctgacgtgtggacaaagatgaagatgaagatgaaatgtactcacagaagcacgaagtttggtcacagcagttcactcaggaaggtgaccctgagatctgggccaatctacaagatatccaaggagatgttctgccttcagcctctttagactataaatcatctttttccttcttggataagcacatttgcaaaaggcatcttccctttaatatatgtctgtttcctctctttaactctgaagacaggcttttgcagctaagtggttctctcctattaatttcatagcatggaatacttcctaaagtttactcatggaaaaggtcagtgtaattcataagaatcagtctcaaagtctcactggttgcttcatgaaatgtttttacgggctttttgcttcttctaaaatcactttttagttaaacagtgtttttttgttgttattgacaaaaccaaataactacttaatcaacttcgatgaacgtttctttttcggtttgatcaacagctttggcacagggagtagcactcactaaaatgatttcgtggatcacttttcttgtttctacagtttttgtgtagctgttcatgttgtataggacatgaacaaaatgaggtgggagccgcctcctaacaacttttcaataaaattaatagactttatttttagagcaattttaggttactaaaaagttgagcagaaaatacacacagagttcctatatatcacttcccccctgcatagtttcgctattaacaccttgcactggtgtggaacatttgtttcaattgatgaactgatattgatgcacttttgttaactaaagtccatattgtgtgttagggttctctctttgtgttgcactgttctatggcttttaacaaatatgtaatgtcatatatttaccattgcagtgtcatacagtttttctaccctaaaaatgtcccatgttttacctattcctcttttccccacccttaaaccctggcaacctctgatctttttaatcctctctatatttttgccatttctcatataacttttcactttaaaaattttttactttctggctgagaagcatgccttttacttatgttattttcccttcattttcctcactgaactagcagaagattttcttttcagaaagaatataaattttaccaccaaaaagttattgtacaggcagccaaagtgtagaataataatagccagcctgaagtgtagttgtttagagataacccaggcccactcacttgccaagtgactccttcttgcacattacactttgaagcataagattcaaactaattcatttacaaaacaataaattgctacatggcatggaccttaaggtgctcttgaggaccctctaaacatgagggttaaatccacaaatgccaaaatgaactaaaaccagtatatttgagcatgtcactgaggctagttcctctaacaagaacacagaggtttgattgctgcctcctcatccacagctgagcttgattcataggctactaaatcaacaggatctgatggtaatggtgactccaacctaggtttcttatattgggagcaaacaggaaccagaatctgtgcttcactgctctcaaccatccttgtcccaggaagacttgagcaccttccattcttctgttcttctgtggccttgtatgttgtgttgtgggttatgtttctcataaactattatacctggtgaattcaattaattcaagcaacattctcaccagttacaggtacttaatagtttgggttctttggatatatctgggcaaatatagggctcgtatttattttatagagataccaaagagacaagtgtaatgcctagcatggaacacactaaaataagcaggtttagagtgtaccacccatggaaggcagaaactgtgtgtgtgtgtgtgtgtgtgtgtgtgtgtgtgtgtgtgtgtgtatatatatataaaacttctgttttaaaagtggactattcttattatttgtgattcatgttcatattttattacttattttagtggttttaaaataaatttactatattttcacatttcacaaaatcactaacattgattacatataggcatagttgtcatctcccattacagaaaattcagagaactatccagatttctttattttgttggatttgttggatttgggttagtcaaatattttgcttattgaaatgatgtgtttattgaaatagagtaaccctgttaacatactttttaaaggttatatcaagaaatatgtaatagaaacagataaaaagcactttggagttctctgggtccttgatagagaagcctttctgtggagtgaccttattggaacattcaaatcctagaagcagagttacctaagatatgctgagatatagagtagggaagctgttaggaatcagatattgtcctgaggatgggagttggaaggaggcaaaaaaaaccatttggtctgggccttgtatttaccaaggaacctcaaattgagagactatcttgaaataagtttactcatgcagcaataagaaacacagcactgaaagatattcatcacacacgcatatagtgtgtgtgttgtaacctgttttagcatatcttccatctatcaggagcccctaaattaaattgccaggagctcttctgacttataggagatgcagcatggtaccttataaaattaataggtgtggattgttataaatttatttttagtaataatttttcccatgacatcctgtacagagtcccaaaatataagacaaatagaagcaaaactattctcttagaatcaaaggtcactggagccccctcctggcccctgagcttgtagctaagatacatctgaggaaacttaagacttcagaaaacaagattttgaaaccgctagactagcttaacgcccttgatttacagataccaacgtgtaggctcaaagaagttaggtattgtactcaacattgcccagctggggagaagcagacccgcagatacacaattgttgggtacttttccagcagtaggaattgctgaataatagtttcactttgatcctgtgttattctggattcagaaacccagagttctcaggaataatggtgtatgaaaagctgttaacatggtccccaaaataaatgcatatgaaaaatgtaacccaatcagtcatattacaaaaccatatctctaaatcattaatacatatcgctatctagtccagccatgatttaaaacacgctctaatgcagttataatattaaggcatatatgtgtgtgtatggactcaggtctggccatctgtactcatctgtgaatataagtatagtcagtcatacctgagtccacatgcacaagaaaaaggcaaggaaaggaacagtccagggtgttctttgaaaactgcagtcatttggtaaatgattatggaataaattccaaaccttgagctcatgctaaggccctttgagatcagcaagtgctttccagaaggggcttttcagcagagtgacatccttgcagctttttcccagatttttttttcacttccttcaattccttcatctctcttcctagtgaacttctactggccctatgctattactataactttctgcttttgagccatggccccttgagatcttggaaaaataaaaagaaaatagagccttgtctggactatagagatttggaagcttattgatccaatttttttttttttcaggaagccagctttgtaatgtctcaagcctatcttaaggaaatacacttttttacaaagcttatatcgtcggacctgcagtgtcttgttggcttgccttttctaattcacttttagtttaggcaacccctcacaaggtaactttgacttcagagatcccagcttcttaatcaaaatatctgaaatcgctcatgccaattatattattcattgtttaaagtgtgcaatgatagcaaaaatcatccattctttcttagactatacttgttgatctcaaatctgttttatctggaaattaacctctttctgacttacattttttgggggactttctgatcccattccctcctctgtttttggctgtagctttctcatggtggtgttgaccattctgaagagtcctgcacctccatgagttatgtgctacagaaagtcttagagtgaggaggaattttggaagtagatcctatgtcacaggagaactcaggtgacaattcagagcaaagagatgaaataccagtagaaataaaagtagcttacacattagccattatgctaaattctacaatactcacatatttagcaaaatgggcatgtttcttagcgactgcctgccgcaggcaacgtgcctgcccatcttcacggcagcacaagtatgactatgaaatgagttgtaaagcactgaagagataagagataagggactgggagggggcagggataatgagcaaacgaaagcaacagatcaacagtacacgtggatgtttattatggtgtactagaaggataagtccattcacattccctgtgtttttttgttccatctctgcactatactgattgtctgctctttacctgacactgtcctactcatctcctgtctgctcttcagttggactcattatatttctactttctggagatgcttattagtttagtttcctttttgcttaggcaggataatgctgtgttttaaggaaaaggcaatacagtttaaagacaggttctctaagtgccctaccttcagattttacccatactttattttggaatattatcaaatccttattaccattgtcaaatccttattaccactcattgttgtttgtttgatgttctcatcaaaaatatttttttcctagtaaaatctgaaggatggccacttacatacgtattaatagagtatatatcttgtttaaggtatgtatttataaccccagatctgaaaaagttgaaacttctgataatgtatgaactgtagctatattgtactatattataccactatatataatcatacacttatcataacaatgataatatcataatgtaattttgtattatataagaatacataattgtatatgataattcatatataattattatgtataatttattataccatattattgttcacaggctggcaggcactgtaattacattctttctgtaatctagatttactcagggttcactgactaaatttatacactgtgggtataaatcatagttacagtttagattctcttccttcataaatgttcttccataatccttggattatgcttctgggaaatcttgtttcctatataagcatgtattatgttcatattttgattgtgttccttttaattattctcactgaactatttcagtattacagctgaaaaagacattggagagtggtgattgaactgtgggtaaactgaggctcaaagatactgagtgagacatcagccatgccactctgcgattttatcattcattcttctttcttctgtgcccccaacgtacacagacctctgtataaatcctgaggctaaggggtatattcaggaatatactcattcccacccagagactgagtgattaccaagaataggggagacaaaatagattaaggatggccttcatattctgagcgggaaagcagctaagtccactggccccttcttacagtcagtttcccaccactggtcttatctgcacactgaggttcttccagccctctccattgctgtgtctaccctgaatctccctgcagggaggcttcttaaggggatgagctgtttccctgaagagccctatgaagacagagaaagcagaagctacacaggtatatctccgtgcagttcatacccagcctttggtactgcctttctgtcatcagttggctgtttgcctcagcacagtggaaattcatcatagaaatgaactctgtcatatatagcaatttagaatacagcctgaagctcagagtgataaaggaggatggttttatgcccataaatatatttaaagctgaggtgagttgctactagaaaatcattgttttatatgtaaatctctactcctttgccatggttattataaataaatctttatatattcaggcaaaagtctgacttaagttgcacatccaggttaatctgaatgtaatataacacaattgctcctcgcttctaaatcaaacactgtaagatataatgcttgataatgtttcattattatgccaaaatgtcaaatttttctcttttattaaggtaagttcaaatcaaagatgctttgtcccatcacatgctgtctcattctataatatttttat

SEQ ID NO: 79 - DNA, 6402 bp, Homo sapiens
acttcttcttatcaatcaggtccaagtcagtatctacagttatttgtttgcgtgtatgtaaatttacatgtgtaaacatatattgtctttcctcactgttgtgtaaaatcttttagagcaatgatctcgaatatcttgtccctgctgtatccctgtacctagcacagtgcaaatagtgcataaaacaatatgaataagtactttttagaatgaatgaataaatagaagggaagaaaagaactctgttttggttcctttagctctctttttctgagaacaatttagggatatccctttgtattccttgtctggtttacctttgtcttaatagtctaaagtcttcccatatagctaggtgtccattgggtgcaggtggctttcatttgcatatgtaaaatgggcagtgctcccacctttctgtgtttagaatgtttgtctggagtgaggcaagtcaaaaatctgctctaagccttaccaggtgagattggggagcagaaggaagaggaaaaaagaagattgtttgtctttaggaacatgtggcataagtctacaaccactgcagttccctggaccatttatttttctggtgtggttatattatttgtgatttatttttaaacacttccatataaacatgtgataaatatatactgtgtaaattaatagcacactctcaggtgttttgttaacatttgaagtgcccactcaaagatccaccctccagagatttctaggaaaatgatttcaatatcactaattagcagcagagaagtaatttttcactggtgaaatcagtagtgtcaagacattcagctggttagaaagattgcacagtatgtcctttcatgatgagtgcaaggactctgagtttctgtccttccttgagcaacacatccagcaaacccacagcccaacacagcaccccaggtgaagacctcagctttgccctattcctaccgcctactcaccccttagttcaggcactgggcacaggattcagtgagaaggaaggctgattttgccatcagaatattttttactggcttccaagtgaacctttcacacaaagtgctaatcagggtgtccaaaaaggcagagggccagaaccttaccacacttaagggaacaggatatatgtttttgaaacttccacctaagaaatgtttgtacctatgggtagaattttctctgagaattattttccctacagtatactattaatcatgaggttgtggggtgagcaggcagataactccacctatgtattgccaaaggctgtctacatttatgaaagaatctgctcattgtacttggaaaactgacttgggttagttcgcagaaagttctcagctctctcacatcatccagagactggcaggctaaggctggtcagctttcagtgaggacccactgggcagggcagttaccaatcaagagagagcccagggagagctgggcacatggtgatgattgccttggttggtcaataataaactgaacaatctgaaaaccttgcttgggaaaactaggggaggctagttcaaaacaagcaaagtgtgctttgttatatattgaaatcctcagggtggcatggcctttattaagagaaatctgagagtagggctttagtgatatataccccaaacctaaagagactcatgtgtcaatttatatttattagcatcaacaacttgcttgtgccgatctatattttcgaatttggcttcgtttctatgtttatctctagttttcctgagtcagccttttctcattgcagcaatttaaaaagttatcttttcaagaaagcagtcttcttccattaatggcttaacttgtttttttcatagtggatcctgaaaaagtacacctttcagtagtctcagactctgaaaagaaagaattctatctacagaccagcaacttagcaaattaatgttttggttcattaaagcaaatcgcagttaaaacacaagaagttatatgacttctaaagtttatgtaagccttacgaacctttttcaagagagtcaattaagcagagtagtcatgaatgtgggttcctgggccagattgcctgggagtgaatcctggctctggttttggctaactgaatgatattgggaaattcattcagctgtgcggcaattgccctccctgtaaaagtgcaatagtagcagtaactacttcatagagtaattttaaattaaattcttcatggcatgagaagtgcttagaatagcaggtgaaacttatgtttttaaaattttactattgccaatgttttcatggtcattcttaatcataccttcagtagataggatgcttgttgagatggacagcgtgcctggattctccctgcaacttaactatcaaccagctgtatgacctggaaaaaaaatgacttgaccttcctgggcttcagtcctcttatttatcaaaagagggattggcctagataatatctaaatgtcccaataatactaaaatgcgatgatcctattatatcattcgccaattgtgagtttagagaaaatactttaaaagggaatatcaaaaagacctaataaaaataaatgaaaaggagagattgtgtttaaatttctcttgacttggaatcaggacaactggatcgaggcctggctgcttactatccttcttaacccaccccacctttcactcttgtttttctttttggctcagtatggctcttggtgagcatgttggcagaaagctgaaaaaggaaaaaaaaagctttgattgaaaacaagcagtttacagatgggttggatgtgtgcatggggtaggggtgcatgtagtcaccatctcgtctcaagaaacctgagagacattccatgttgagagaagtcacatgaagtgaagccagtggtcacatctaaaaggagaccaactcctgcacgttataagatttgaactcagaaagttgttatttatattcttgtttatttcaaaatatgcaacacgtgctagataagcaggtagacttatccagtgaatgctggataagcaggtagacttatcacttatccagtgaatgctgaagagctctctctccttgccaccctatggatcggattgcccccttcagcctgagttcttcccttcacccgttttgaatctggctcttgctcagtgggcagtatgatctaaaagtaagcctctctgtctcccaacaaggtaactctatttctgtttgtaaaaaaattttttataaaatatagaaaatttggtcttcagtctttatcatatatggaaaaccttcccttttctgaagagtgattccattagctaaaatattaagtgatcgaatactaaaacaaccaacttgactaacaccttttagactattcactcacccctgcctctcataagggagtttgaaaatttagggagttccccttcagcaaagaggctattgtccaaatagtgcatcatatgcacagctccatgcaggatgcttattaagacacccttattcatcctgagctgacccaaatgcaagcaaggctctctgagcttctttctcaagggcatagtgagaacattccctaccacccagctgtgtagtgcagtttaatgaggaaatggatgtgaacctgacttttagactagaaaacatacttccaattaggtgattattttaagcttctagctaaagatggcttaatgatcaattctgtcttgtagttggaaacatgaactgtttccaactcccaagagcttccagtttttccatcctttccatcatttctatgactctgtatgcatgttcttcatacatgagatgtgatcattaacaaaattcattctggtaccctttctgtatatgaattataatctacacttttattatcatcctttcatgttccataattccagtatttcctagctttccttccatggcattctgcttgtacaagtggaaaaatcaggtaaattacagaaatcaactagtctctttatataaaacagaaagtcatgaaatataaattaaaaatatacaatgcttttgtcataaaactacaaagtattcaataacagcaagacagaaaacagggaggttgcttcttccctattgagagcacagaggaagcccctctcatggtgttgagttgtctgtctccatcatggtcacagccctcttgctaaaaccagaaagatgcctctaggtggtgattttaaaacattaaagattttaagagttgccaactgcaaagagttggcattctaagcaaactgtaaagaatcctgtaggcctggaattgagacctgagctaacttgttgctggtagtctcaccatgcttgaatcctcacgaatgcccccccagggcagcatgccaccagaggcccccatcttctgctttgctccgtaggttatatgaccttgccttccagtcccaggaagcctgctgtcctcctgatgacaaaaggttcaagtgccctcagggatataagcatagaaggtaaattttacctattgcctgaaaacctaactcagcatatgagtcctttttgtgtctaccatttaatttttttgttatgttatatgaaaaacaaaacaggacaaagtgacttttaaatagagattgcagagggcttgattgggataaagcactttctgaggcatcatctcctttaactcttacacatcttggtgaggaggtagtatttttacaatgagcaaattgagattcagggtaagtaacttttctatatccccaaactagccaatcatttgtagatatattcagaaaactgacctcttcttcactaactctaaaaattgtcatatgtagaaaatcctgttataaaattaaccaattttatacatgttgtattagggttctccagggaaacagaaccatcaagaggaggtgtgtgtgtgtgtgtgtgtgtgtgtgtgtgtgtgtgtgtgcataaagagatttattatgagaaattgactcatgtgattatggagcttgagaagtcccaaaagctgcagtcagcaagctggaggcccaggaaaactgatagtgtaagttcctatctgaaaggtgacagattcaagacccaggaagagccagtgtttcagtcagaatcaaaaagccaagaaagaccagtgtcctagctcaacagtcaggcaggaggagttccctcttactcagcctttgtattctttggtctttgattgttggatgaggcccacccacataaggaaagttaatctactttgctccatccgtggcttcaaatgctaatcttatcccaagtcacccgcacagacacaaccagaataatgtttggctgaatgtctgggcaccccatgacccagtcatattgacatgtaaaattaaccatcacatgtgttatatagttcttaggcagggaacactggtgtttgttgactactcaccctgtgctctttgccaggcactggaaaagatttaatcaaagcaaacattattgtatttgctttggagagattggagaagacagggctgatctcaccatcaatagcctctagagtatcactgtccattagagatagagggcagtttacatacacaagccacatgcataatgttagtagccacatttaaaaatgtatttttaatacatttttaataaattctatttttattttttaataaattttaagtttatttaacctagtatgccaaaatagcattacaacatgtaaccaacatgaaaattattaatgagatactttacattctattttgtttttaccaagtctttgatcagtgtgtattttttagctacaacacatttcagttcagtccagccacatttcaggtgctcagcagcctctgactaatgcctgctgtagtggacagggaagccacaagtgtctgttgtagaatgctctatcttatgtatcttattctggtgtgggttttagacccaagttactgagggtttgggagaaagagcaactgtttggaggatttgatataacaccaggaaagtctgagtggtattagactttgtcaggacaagctgcttgggaaaatcagacctagatgctgggtagttactctccatctagagattgccaggactgcattgttagaaggttatctgttacctctggaccagaataggctggttcttgggcagccctgctcctagctactacttcctgctctgcattactcactgccacttctctcccaagccacagttactgttccctgctacaagaaatcctgggactgggagtggggaggctggtctacaaaagattgagccaaagcacactttatagaagtttcttcgttgcacaccatttgaggggaacatactctagcatcacaaggtttagctaatgtccccatcaaaagtacataatattatgtattctgctcacagttcccacc

SEQ ID NO: 80 - DNA, 4722 bp, Homo sapiens
aaaaaacggtatgctgcattatctgtttgtttactattggatcacttccccttttttcctcaaataatagcattttattatgtggtataatgctttgggaaatgtaatttgcatagattatttttaggaggcccataacaagtccacaagggatataaatgatgctatttataaaaactagtaattgcagagtctttcccctagtgcttcttagaaacaacttccttagtgttactttttgtcaagatggtaccctcttttattctccaatcaggtgtgactcaagggtcatgtgcacaggcttatttgccatggaatctgagccaaatttgaggttaaccttgcctgggttttacaaaatgtttatcgttccttgatattttcttgttcctcgtgtctcaaaaactgttccttcaaagtctcatcagatagtacaaatcttttatttaccttcttgaactgcctcttgctcaggtttcactactgatcttactttgcttaaaaaagagaggttatggcctggcactgtgtcccacgcctgtaatcccaacactttgggaggccgaggcaggtggatcacctgaggttgggagttcgagaccaacctgaccaacatggagaaaccccctctctactaaaaatacagaattagccaggtgtggtggcacatgcctataatcccagctattcaggaggctgaggcaggagaatctcttgaacgtgggaggcggaggttgcagtgagccgagattgcgccatggcactctagcctgggcaacaagagtgaaactccatcatctcaaaaaaaaaaaaagagagaggttatagtaccattaaatatatgtggacacaaaaatgttatatgtaatggaatttatggtgacttcgttccagcccttaagcttatggtaaaagagtccctctattcttaggctgaggagctccattccctctccttcataaggatcagacttatttcctaattaattgacttgatcaaaattggtttacttgcatacagagaaattcactaatatttgagtaacatatttgagatgctctgtagagttggattatctcttcttctagactaagcagattcccatggagtcaggctacggggcagtcttcctgggattcacttctggcagttgattacatcttacatcagctccttagggatcaagagcatatggatgaaagtgacctagacactcctatggagaatgtagaaatttcttcattaccaagaccaatatgggaattaaagcttaagagaccaagatctcttattattatttttataaaataagtcatgagattgcctaatagaagaaataaaagaaaaccactcactacccttcaagagaaaaccattatggttgtaattacttattttctctttttattcttctacccttctgctatttgaggaagtactgaagacctgagggtttactattgtaaaggtcatgataaacaatgggatgatttctgagtagctttgtacttttggttgaagatggtaggcaagtaatatggttagatcacagtgtctatcagcttttggacagcaccagctagtttctcaatgtctccaattttccaataaagtaattgttttacttagcatttacaaagttattttatcttcctagaaatatatatatatatatataaaacacatcctgaaagctatgaattctcccacaactatgaatatatatgattgtttcaagagtgaaaaatagccttgtgggtaagggtatctttcatcttatactggaattaaggttgctcatttgttctttttgcttctctatttctgtaaaattacagtgactcttggtggccttttgactagagtatggatgactggattttttggtttaattatctttaaatatcgagtaatatctgttcattcctagggatgcaggttgttattcaataaatggttctctaatagtgatttataaaccactagactttgacaacatctagcatgactccctcaacaaaactgaggacacttcagatatcagtgatttaggtttcttccatcccactagtagttctatgtaaacaaaagcaatgcgtaaagctttcgcagttcatagcaatttgaaaatcactacgctaattaaattttaaaattttcttcaaggagcaaaaaaacaagtcagttcaggacagaagcctttacacagccttgccttttccttaagatttgataataatcctttccacgttaaatttgccctgtgccgaggaaatcttaatttaacatcacatggtgactccattagttgtcagttaaacaaacagtttgcatcctgaagagcaaaaacactaccctgttaagtcgctaagagggtgttccaaaacagcacgaattagctagagctcataaaaaagaagtgattggtatgaaagaatgcgaaacctaaggtctgattatactcctcttcctgtaacactctctgtttccatttgaggatttgttttcccccgccagtgtacatagaaatcctgcaaaactgatctgaagccattccttagtgttgaatgtttgagaatgtgcaaaacactcaaggatttttaaaaatgtcttacacaatttgacattgggtgtttaattttgaagaggttttaacttttgtattgcttgctttttggttctttctggtgcgttcactgaatctcatcagataaagccccagtgaagagagtatatctttaagttcttacatacaatagtttctattttgtgcagagcagctggaggagatgggccttttcagtcataaggctaaattccccaccaatgtcctttcttgaggaccttcacttcccaccaagaaatttcataagtggatcgcaaaaaaatgtcttaaatatgacagctgccgtcttccgggtacaggaaagtataggtggaagttgttgtgaccttttagcacacagctcatggactccacaatttcacccaatttttctaaactatcagcacttttaattggcagagctgcccttcctatctctgaagtacctgcactcacactggcactgttgctaatcaggagatttaaaccgagggatgattcattgttgatgaccagttttatgaggtacttccttctttctgaccctaaaagtagaagaatgacctgaacaagcaaatcactataaaggaggctcgggttgcccaggcccaggcttaataactgggctcaaacaccacacactctcccctcttttcttacaatgaggacatttgaaattgacctccacccttagtagcaaatatcaacttgtatttgaagacacttagagggcatttttgatagaatttgtcatcaaaacttccttgaaacttatttattttcatgacctgaggaaaccttgtaaaactccaatgggatataatattaaagcagagtgctttataaaatgttacttgccagaattgattgtttcacatgtttttatgaaagaataattatttatgtcagtcaagtatagtaaaaatgtttttatggttctggcacattgagtcagtcagccccagggacagaaaaacaggcaatgtgttcaagtatttgttttaccttccttttggagggcaagctgatttgtgaaagatcttaaagctgttttatttttacataaaagcgtgattttttttcaagttaactattttggataaattttaattataggctaatagtctatttagtctaataaactggctgtcaaactgaattttgaactttgaggagcaggagctattataaatcccacaggaggatactttaagcctagaatattttgaacattagtgttttttatcagagccattctctgtagcagtaaaaattctggaatttgtttaaaaagtataaatttcattattatgttgaatcttttgaagatgtctttttcacagttgaaataatcaaaacctttccacagtgtgttatgtgaaggaatttctctttttcataggcttgtatccttgttattaaagcttgatcccaaaatggtttttcaaaatgattcttggaagtatttgcaggatcagcataagtagatgatttagggcaaaaatgtgtcacattttaatttttcaaatattatgtgatacatgcttttgagggaaatgggatacctgaacttcttttacatccaagggctcaacatggcttacagtttctgcgctataatggagaagaatacagtggagaaaaacactacattttaattttaacttggcagcatctaagactatccacgtgttgggatttccctagaggtacataggtaatagtaactaattgtcatttgtctgttcagtttaatctggcttggcttagggtagtaaacgttaacaacacttgtcattacttaccttttctaaagcaaagtccttctccctctgccccccttaacttatccctttttctctctttcaccatcttctctgttagaaggaaagatgataaacaagccaagcgaaacctgaacctttgcttttaatatattgacttcctaaatacactgtattttcttcattttgtttttaaatgcccaagcatcttgaagtgacaggttagtgattttgcttaagttttttctaagaagataaatgaaatgagagaaaagtaaccaggatacattttctgactttggtgaaaggaatatgactcatcttgttaaatg

SEQ ID NO: 81 - DNA, 46034 bp, Homo sapiens
tggcataaagaagtcctagaccatgtaataggctataagtatattcagagtcataggcaaggtaaatcagtgagggctagggcagtcagggaagggtttgtagccctagaagaatgggtggagttcagataggcaggcagtaaataggagagcactctagatgaagggaactacaaaagcagtttcagacacgtttgagcattgtgtttatagggcatgtggtgctggccagcctgagagaaaggtacatgttggagaacagtggatgagaaagccaaacaagtaaagaggagacaatttatcaggaatttgaaagccaggtagagcttaaatttgatggagtagccaaaagggagtcattggaagttactgagtaaggacaaaggcaagactagaggtaatttaggaagagtaattttttgtttgttttgagacagggtgtctgtcacccaggctggagtgcagtgatgcagtcatggctcagtgcatccctggcctcctagcctcaagcgattctcccatctcagcctcccaagtagctgggaccacaggcatgagccaccacacctggctaatattttattttttgtagagacaaggtcttactatgttgcccaggctggtcttgaactcctggtctcaagcgatgctccagctttggcctccaaaagcactgggattatagattgatctgccatgcctgactggaagagtgaattactctttgaatttcagagggcacagaaattcaagaaactaggtacaaatgtaatgaagatttaatatgcttgtgaggctaataggtgctttgaattatttgagaaaagggagaactctaccaactctgcagttttatgcttacatttcaggatcagtttgttcattcagcagatatttgttcctaccaattatgtacaggatgctgtgggagatatgtccaaaggagcttatggtgtaggaagggaaataggagacactatgtaagtaattttagtactgaagaaacgtggtaagacattgacaggtatcagcgaaatgctttgtgagaatatattcattagagcaatgccgtcccataggaatagaatataagccacatgtaatttaaatttttctggtagctgcatttaaaaatttttttaaagtgaaattgattctatctgtttttacttaacccattatgaacaaaatatgatttcaatatgtggcactagccacattttaagtgaatagccacatgtagctatggctatggcttaaacagcttaagaaaggcttcatggaagggatggtatctgagccacactgtgaagaatcttgtatgcagagtaaatttgggaaaagccattccaggtagagggagtggcttggtgagcaaagatagaaaagcatactttgtatgtaagaaaaccattttggcagaagcacatatgatgtggaaggcatgatgtgggggtctggaagataggttggcaagctttcactgataggggaggaaatctgactctgcttttggcatcagggaactttaaagaattttgagcgggaagtgacttgagcagagttataggaaaatgggtcttacagcaaaggcatggagggggctgtagataatgagtgactgaaagcattgccactagggcaagattttggatgggagatttattgtagatgtagaaataggaacaatttcatttctcctttgctgccttcctccaaactgctgggtgttgtgtaacccatttcctgttgaaattggtctagttgcttcaaaatccatgttatataagtcaaaagttatgtaagcagtagccatcaggacctttagctatggattttgtttgttgtaagttgtttctgtatgtgtataattaaaaatatttgaaacagataaatggatacagattttaaaaaggtgtgcattcagtccttatcttgccatgatggttctcaatctctaagaaatcttgcagtaatctcggagaagcttaaaatagctgaccccaaacagaaagggtgcattttattttgggaaatagggaaggcatatttgggaggtcccactgaatagtccagattctttggagtagtatgatttaacttttaatccttgagaaggagagaagtaaaagggggatagcttaattttggggcctagtagagctgaagaggttgatggcattatttagcaacggcaatcctttattactccattatgataccacatgggatggcttagctctgaattggcttttggccagtactttatgatttggagtaatccacaggtagagttgcataggtactgttctatgaactttgaagtgggcctctaagtgacttctaactttgagttagtctacagactggaaattttctgaaggttgttgggtcattgaaagttggcttctttctggtgtacctggcacttttagaaaccatgaagtagggttatttaatgatgaagatatttattgtcctgatctcaaagaccttatggtcaagaaagttagatatatgaagacagtggtcatcctttggtatccagggggtgtaggttccaggacacctggggataccaaaatctgaagatacttgtttattttgtgtttttttccttctttattttccaccacggttggttgaatctgtgtatctggaacctgcagatatggagggccaactatatatacttttaagatggtagagtatttttgatgtacttgtattagagtagaacaggttgtcttgtggtaaccaacagctccagcatctcaatgttttaacccagcaaaagtttcttttgttttcaccctgcgtgtccaatgcaggtctgcaggagtcttgcactatacagtcacccggggactcaggctgacaaaaactctacagttgcatgactgtaccacctagaatacatggccttctcagtggctgctgtgagggaaaagagcctggggaggcacacgtaggatattcacagtgttagcctggaagtagcgtcatttctacttatctttcattggacagaactaccatgtggcctcttctgactgctgtgggggttctgggaaatagaagggaacaaatggaatgtttcttgaggattactctctctgccttagttttattctagtgttgtgagtgaagatgtcagatggatcaaagtgagacttgcctcactgagtgtaagcttacaattagtgagccttatataagacacagctctgcatgtgatttagataataagcagtaggaagaaaaattatagttatgaactggagaatcaattctttctgaatcacctagattttgagtgtatcttattgtgctccctaaaacatttttaggtgataaggccctgtgtgtagaatttctctcttgaaaatacagaaatgacttttgaggcaaaatcattttgtgagtggaggtcatactttcttgttttttttttccttttttttttgagatggaatcttgctctgttgcccaggccagagtgcagtggcgcgatctctgctcactgcaacctccgtcttccgggttcaagcgattctcttgctcagcctccccagtagctgggactataggcacgtgcactgtgcccagctaattttttgtttttttagtagagacggggtttcaccgtgttagccaggatggtctcgatctcctgacctcgtgattcacctgcctcggcctcccaaagtgctgggattacaggcatgagccactgcgcccagcagaaaatggttaatttaaaaatagcaaagaggccaagtgcggtggctcacacctgtaattccagcactttgggaggccgaggcaggcagatcacctgaggtcaggcgttcaagaccagcctgagcaatgtagtgaaaccccacctctactaaaaatacaaaatcagccgagtgtggtggtgcatgccagcagtcccagctactcgggtggctgaggagaatcgcttgaacccaggaggcagaggttgcagtgagccgaggttgcgtcactgaactccagcctgggtgacagaatgagactccgtctccaaacaaataatcattttcagagccttaaattgtgataccatgtatgtagtaatgaaagaatttgttttgaaaatactggcattggctaggtgcagtgggtcacgcctgtaagtcccagcactttgggaggccaaggcgggcagatcacctgagtttaggagttcaagaccagcctggccaaaaatggcaaaatcccatctctactaaaaatacaaaagttagctgtgcatggtggcacgtgcctgtaatcccagctacctgggaggctaaggcaggagaatcacttgaaccctggaggtggaggttgcagtgaaccgagatcccaccactgtacttcagcctgggtgacagagtgagactctgtctcaaacaaacagacaaagcacacaaaaaaacctgacattactactactgtttaaagtagcatttcatgtttttatagctcaggatattagtgtatttttatactgtgtggcacagattgatatatcaatatttaaaccaacagtacataaaattaactcttcttgtttagtaaataacttttcaattattttatccaaaaattacttattaaaattaccgcactctgtaaatggtgattattgcagtggggaactgactgtggtgagttgataagagatattcactgattggcatatggatttgataaattgataaactgaagtcactaggatttttgtctatttcagaaaaactttaaatgaactcagttatggttcagatgaattcagttatggtttcaagttatgttgctgtacatcttgttatacacccctttctcttgcaacctataccatatacaaaattagtgcctgatatttttatataatgctttatactttttaaggtgccttcacatgtatcaggtcttttgttcctcataacaggcccactaaaagagttggtagtgttctttctttttttttttagagacaggggtctcagttggttgcccaggctggaatgtaatggcacagtcacggctcactgcatcctggaactctgggctcaagtgatcctcccacctcagcctcctgagtagctgggactacaggtgcacaccaccacacccagccaattttttcttcttttgtagagatgaagtcttactatgttagagactgatttgccaggataatcttgaactcttgggatcctaggcgtgagtcaccacatccagccctgggtagtgttcttattgcccagtagagaccgaagctctcaggttaagtgatttaaccaaggtcatgccacttgtaagtaagtagcagagctagtgctagatagagcccaagtctgactgcccttagtttatgttcttcctgtgcagtgtgtcctagtaacaaagttagcagattacagaagatgtgatataatctttcccatccttcagttatctactgcttgatgggtgcagccaaatagatcatttaaaatcatatcttttgcttcaggattggttgaaacaaacatcatacttactctttcctgtactatggaaaaaacaggtttagtcaaaaccagagttgcttacaggacagtgaagagaggacttcctgtattacaggatacagttggattaaggtcattaaaacaaaccagacaattactgagagaagtcaaggacatatatatagtaagcataaactttttttttgagatggagtctcactctgttgcccacgctggagtccagtggcgtgatctcggcccactgcaacctctgccttttggtttcaagcgatcctcctgcctcagcctccccagtagctgggattacaaatgcctgccaccacgcctggctaatttttgtatttttagtagagatggggtttcactgtgttggtcaggctggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaatagtattaatttaatgtataaatgcagactctcaaaacagcttatgagagagaggtgtctgaatatactggaaagctgccaggtatttacaactaatttttaagcatatgatataatttgtgtcacctattgcctgatcagaggttgtacatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcctgctttggtctgaaagttaggcacatccatcaagttcggcatgcattccagagccaaattcaaagtgttttgggcattctcctctcctgtattttacataaacccttagtcagatgattgattccctctggccgccacttgggattgaatgggaggggtacgtactccaaaacaaatcataatcatattgtctttcccgcacatcctgagccattgggaactttctttttcttccaggtgaaatcaggtaaaaatgaactcagcgagggctgctttgaagggaaaaggaattcacacttggggacctaccaccttccctgctggctgcctttctaaattactgcccatgactcctttcttttgaaaaccagtataaagcttgtcagccatcaggcagcaccccttatccctaacctattaggagttacacactgtctgtctacaaagaatattaaaacgactgccgccccctgcatcttctcactttggttgattaaatccccttataactaagctttgcattgagcttctctttttattagactcatggcgtaagagtgtcatgactaaatttgttgcctgttggtaatttgggggtttgttaatggtgcactaattcctgaatgttaggtacatctggtattcagatgaagtatgtcatgcattccaagggcaagaaagttccataattcatgaaatgtagaccaacttttaagagcatctgaaagaatgtgaagaagagcttggtacttactgcctcttaaccagtttttcaggatgccacattctaaaacaactcttcgaaaatattgctctgtatacgaagcttggactccttcagaactacttttgttgtaagcataaatgtttaaaggaatttattattaatagtattagctactctttgagtgcttactacgtgccaggcaacgtgttaagcgctttatgtatgtcaacttatttatcattataactaccctagaagatggctataccctagaagatgacccttcgtatagctgaggaaagtgaggctcaaagtgattaggtaatttgtccagagtcatacagataataagtggcagaagagggatttctacccaggtcagattgactttaaacttagttcttggcagttttgctctattatcacctttttcctcctaaggaaagatattttttcccctttaattatagaagtaataccagtttgtgggtttaaaaatggtggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagtgatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggcatctggagacaacaaacaaagtaagtaatatctttaaaaagaaattcgaccagtaatggagccagtcttctttcacagggactttttaacgatttttgctttgttcgccatagacaccaatgtcacagtactaagaatttaaaagaccacagcattgtgacgaacggggtcatgggcgggcaaataaaaatttatctgacagggaagtatggagggcattacaaacctggtgcgcagtgtatttaaaaagatcttatcttgagtattatttgttagctctctttttagcagtgaactttttatacttggtggtacgaaactaccctagtgatgcattgcatttatcacatgtattaccgtgatggtggtaatcttaaccacactttattaagtgcttctgtgccaagtacttccgagtctcacttactcttcacacagccttacgagttaggtggcaggctgcccatttttcatataaactgaggtttatggaggtttctacttgccccaagccacagacctagggagtaagagttgggaattaaagtttggatctatcgactctaaagcctgtgatgtttgcactagaatgtatggtttttcacattctatattgttaaaggttatagctgtatttaactgctttagtagactttgtcataattgttttcccccaaagcatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtgatgtgagtttccagacattttgagttttagtttaaataaataaataattttaaatagaagattgctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagggtaataatagcctaggttcccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaattaccattaattaaacagcctctttacacccgttacttgatacctctctaccttccacaacaaaccatgcaggtattaggtcctctttagtgacttctaagatttggtatggacagttattttgcattgtattcgagcccaccatcccttccccattttttaactctgagatacaaccaagccagtgaaataggtaacctatggttgcataagtcttggtcatcaccaagctggcgtctcacctgtcctcacactgtatggtggcctgcagagctggttcctcacaggatttgccccttctgaaaacatccacattaccacaaggagagaaaaatatcaggatagaggggtcttttttagcccaagattagaattagtgcttccttgctactctgaggctggacagccagatgggcaccttctgtccctagtttaggagctgttccacctgttgaagccacactcaaccaaaagtcagtgggggcctacctgctctgttggatcagtgagaccaggaaagtcctatcagaggaaaagtgaagtattggtgctcagtggagtagttgttttgtttttgtgttgtttttaatgtccctataccacagattgacgctgcaagctcagattcacagtcttgctctgtttaggtcttgctctgctattagttcccaattgtccgcatttaggctgagccacaagtaactcagtgaacctccctggtgtaatggatgtgtaatggcttagcagagggacagggaatatcccaggaaaaggggtcttggtaatatgagccagtaccaagaaaggccttagtggtctccagttctcatgtctcaaagccatttccatccttggtgcgaaacggtgggactggatcaggctctctggaggaagacatcttcaatggagcagggtaaaattctctacacaagctttgaaacagtggcctgttcggaattccgtttgtgtgtgaaacgcaaaaagcgcggtttgggtctcctttcattcttgtcaggagggaatcattcccattttacagagaagggaaacgggttcagaaagatgatcatctgttccggggttagaactcagtcccctgcgtcctttccgtcccagtcctcggctctttcaaaagagctgggggttttgagagctccactcaagtcccagcagccctgctcaaggccaggttgaaggctttttccgcctcccagggcggggtcagaggtgtccccacctgtagcttttagatccccaagtgctcgcaggtggggggtgggcccaggagggatcccgggggaggggcgtccgagcgcgcccacgattggtgcgcagggacgcgggggcggtaaagggaaggggcgggcccgcgcccaggaaggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacggtgagccccggggatggggcgggaggggaaggaccgacggacaagcaggcggacagacagaagccggaactgggccgcttgcgctttcatcttacactttgcagccggggaaactgaggctcaaagataacagggcgttggcagaggcctggcccctgagacgggaattggtaattagtgtggtttactgctattcctctacagaggagagagattagggtcgagtgaaaacagatacaggctttgtgggggtgggggtgggggtcaggcggaccagggatagaagcccagcagccgtgtgactctgggcaagttactcgaccattctgagcttcagatgcgtgtctggaaaatgggggtcctagctgccttatagagtgcttgtgaggatgagagattcaaagcacctggtgaggaagatgcccaaggcaacacagctggtgagcaggggaggcaggagaacccagccttgggctcaggcctttcccagcgcgacgtgagatccacactgggcgcctctacctgcacgggctctgaaaaaccgctgcctccaggccgcaaggccgctttctcagagctgatagcattgattagagcttgtccgatgagtttgcctgcacttctgttgagagtggagaggatgagtgagcttgggcaagccttcacgctctgcaccttttcatctgcaaaatggggctaaggcgtattctccaataacataaagaatggagaactgctgtctatgcataaagaatggtaactgcttgttacctcgtaaacgctcttaagtggtaacctaaaataaataaataaataaataaataaataaataaataaataaataaggccaggcgcagtggctcacgcctgtaatcccagcatcttaggaggccgaggtgggcagatcacttgaggtcaggagttcgagaccagcctggccaacatagcgaaaccctttctctactaaaaatacaaaaaatagctgggcatgatggcggacgcctgtaatcccaactgctggggaggctgaggcacgagaatcgcttgaatccgggaggcagaggttgcagtgagccgagactgcgccattgcactccagcccgggcaacagagcgagactccatctcaacacaaaacaaaacaacaaacaaaaaagaaacaacaacgaaaatagtggctttaacattctgatgtaagactccagaaactcacccaaaaaatggccggcgtccactagagggatcccttgcgccaggtcgcctgggtgaacctggtggttgcctgagtgggtggtttgctagggaaggggttgttccgccgggcctgttccccgccccttactgggctggattcctgggcacttttctgtttgttctgctttgctccacctcctgcctcttcccatcttcctccaagccctgtgaatgaagtgggactcggcctggaaaccgtgctgcagagagaagggttttgccccaggtatttatgataagactaggtggagaatccgggcttcctgaaacttgctccactgtgttccccacagcccccttccatgtctctgcactagcagactccctgaaacaggtcacgtgtatcacccaggagagacacaggctgcagcagtggccggaggctgggcatcggctgctgttttgagacattattttgtgtcaggcacaaagttacaaacaaggcacttttacataccttctttatttttcagtccctccaacaacctggtagttggtagtatctccctttgttaggtgtggaaaagtaggtaatattaccatcattccccctttacaggtgaggaacaggctcagagaggtaatgtccactttccccagagccggactgcttgagatctaacctcagctctgccctgcagcacctctgagttttaatttcctcaaagtgctgccaccccttgtcatatggacattgttatccactcagtgtactttagaatccagaatagacctgacgctgccacagacctttcatgtttcttattctcagttttcccatctgtaaaatgaggggcaggaatccatgctcatgtggctgcagggagttggttgaatgagatcataactggaaggttgggggagcaccatacacactaattctcagcttatccttcctgagcctttgggctcttatctcagttatttgggctcttatcttggcttattgtctgggacccagacaatgactttctctttattggctcccagttaagcacctcgaggggtgggtgatcaaggtaagaaaattccctaaacttgctaatttctctcctcttccttctgtccagcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtagaggatgaagggtgtacgtctttgggtagatcggtgtcaactacctgcctggtagaggggtgacaagcaacacctcactttacagtttacaaggtcctttcagtcaagtttcaggtacagcaagcacctgaatgacagccgttctttcagtttcatcttccgtgaatgaccagacattacctgtgtatcagtcagctctcgctgtgtaaccaccttcaaatttagtggccgtcaacaacaatcatttatttagctaataattccacagttggcaatgggcaaagttcagctgggcagttcttctggtcttggctgggttccctcctatgcccactgaaagctgagtgggagctctcgctgggtatatgagggagcgactggctgtcagctggaacatcttggctttcctccctatggccttttgtcctccagtaggctagtccaggctattctcatggtattctcatggcaatggcaggggctcagaagacaagagtggaagcacaccaggcctcttgagaactaaatgcagaactggaaccatcacttccactacgttttttttttttaattgagatgcagtcttactctgttgcctaggctggagtacagtggcatgatctcagcttactgcaacttcctgggttcaagcctcctgagttcaaacgattctcctgcctcagcctcccgagtagctggaattacaggtgcgagccaccatgcctggataatttttgtatgtttagtggagacagggtgggtttcactgtgttggccaggctggtctcgaactcctgacctcccaaaatgctgggattacagccatgagccaccgcacctggcctctttcactacattctattgaccaaagcaagtcacaagaccagcccacattcagagtgagaggggagtagaaattataggatgaagggtgtggctacaggaaggccattaattggggccatcaaggcaattaagttattgaatcttgtttttaagattgtcttacattagatgtaagttccatcagtgatcttgttcttagtcattattgtatcccaatacttagaataagatgtgaaacatattaggtgctcaataaatatatgttgagccagtggaggtatgtcatttgagaaggattctgattatttctctgactttttatatgaggatgttgaggatcagcggccatatagcaggtcagtatgtctggaacagagggcttaaacctgggtgttctgtctctagattttataaggatagttgatcagttaccccgtagcctttggagtgtctgctattctagggaggatggggacagtttttgtagcctatgtgtcagaacttttttttttttttttttttgagacggagtctcactctgttgcccaggctggagtgcagtggcgcgatctcagctcactgcaacctcctcctcccaggttcacgccattctcctgcctcagcctcctgagtagctgggactacaggtgcccgccaccacgcccagctaattttttttgtatttttagtagagacggggtttcaccgtgttagccaggatggtctcgatctcctgaccttgtgatccgcccgcctcagtctcccaaagtgctgggattacaggcgtgagccactgcacctggcatgtcagaacttttatcaagtgctactgtgtgccaagcataatccttaagttctcaacgagggctctcaaattcccagtcaataagaggctatccctgtggctcagaggagcaggtagacttgaggagatgtagtaatgcactaagggttatctgtgacagagagacggggctgtttcctgtctttgaggatcaaaggaagaaagactcttaactgtgtattaagttcttcacaataataatggcagatttatcatgtactttctgtgtgttaggttttctgcatacatgtatactccttaaaagggtacctggcatactgttaagcttctaagtgataactgtaacaatcaaagaattacttctgttggctgaccttggacaagtcatttattctcattttccctctggggctcagaggttaagaaatgactgaaaggattctcttatgactggcatagataacaagggaagtatgtaatgcccttagcaggttcttgacccacagtggggacccagtcaacgtggttaaatccaagctgaggcttgagttgaaagtggaaggcccctgtttcaggatgagaggtggaggggtatgtgcaaggcatgggtttggaagcaagatctgttgtgcaacacccactggggagcctcaaatgccaagttgatatagttctgtggatagaagctactagagattgaagggatgtggtcagaattacattttagaaagagcatcacagtggtagtgtgcaagctaggctgggaggcagtgcttgtcatccaggcagaaaatgccactagctgagctgagcctgtagccacagggatgagtggagccacagtcaccttgaagtggggggttagtggtctttctgcgagttcaacaagagggatgggggctatgtgaactagaaggtctttccttgttctcaagttctgtcctgctggcctgagtcaggagggttacagaatgggaataggatattgtgcatctttaaaaaaattgaggcggggtgcagtggctcatgctcctaatcccagcactttgggaggcccaggtgggtggatcacctgaggtcaggagtccaggaccagcctagccaacatggtgaaactccatctctactaaaaatacaaaaaactagccaggcatggtggcatgcacctgtaatctcagctactcgggagtctgaggcaggagaatcgcttgaacctgggaggcgggggttgcagggagccaagattgtgccattgcactccagcctgggcaacaagagtgaaactctatctcaaaaaaaaaaaaaaaaaaaattgaaatgagtctgttgttgcagtaattcatgtattggcaaagtttaaacaatgtggaagggaagaaagtgaaaaacaagactccatttctttcagccctagtccccaaaagtaatatgaatacattttatgtgtctttttcaaaatttccaatgtgtagatgcctactttagcctgaatggattttttttttcacttaacaagactgtcaggccatgtaacctaccacattctcttcaactgtgcacatacagtagactggtgtacaattgaggctcccccttgatgaataccccggttgtttctagtttgctgatagaaacaaggatgcagatatgggggtttgaatctaacccttttgcccattgccttaggaagacaattaaaagccagtatgcagtatagatgaaacctgtgttcatttcgttctccctcttaaatctgttttttcttttctgtttttatttttttgacacagagtctcactctgtcacccaggatggagttcagtggtgcaatatcagctcaccgcaacctccgcctcctcggttcaagcaattcccctgcctcagcctcctgagtagctgggattacaggcacccaccaccacatctggctaattttttgtatttttaatagagacagggttgcaccatgttgtccaggctggtctcgaactcctgacctcaagtgatatgcccacctcggcctcccaaagtgctgggattacaggcatgagccactgcacccagccttccttaatccgttaacttgagtggtgacactctttgagcttccataccccatccctaacatgcaggattgccttttccaggcacagcaggcatgcagagactggtcgtgatcacctttgccattcctttctacctgaaccctctgtcagtactcttcctgtccttcctccctgtggcccaggtggcgtgtgacgagcatggctcccggggtttcggctttgtccattttgagacccatgaggccgcacagcaggccatcaacaccatgaatgggatgctgctgaatgaccgcaaagtgtgagtggctgggcccgagggaggggcggaggctgcagggacagaagcatggcaccaccgactaggaatcgatgctaccctcaagctgctaatgggcaccaggcacttgagcggcaggcagccctcctagaagtgtgagcccggagcagctgctcaacctctcagggactctttcctcacataaagatggagctgatgatctgcattagagtatggtaaaggaagtggtgattttaaaactctagagggactggctaatggtcatatcatcaatggactcagtgttttcatctgttttccagccttctcagtatggggtgtatgtgtgtgtgacagggtcttgctatgtagcccaggctggagtgcagtggcatgaacacagctcactgcagccttgacctccttggctcaagtaatcctcctgtctcagcctcctttgtagctgggaccacaggtgaccacatgccaccatacctggctaattttttgatttttttttttttttttgtagagatggggtctcactttgttgcccaggctggtcttgaactcttgggttcaagtgatcctcctgcctcagcctcctaaagtgttaaaatgctgggattacaggcatgagctactgcgcctgactttttctttaaaccttttgtgtttcatgagattttggcagaaagaaaagtaggcatatgctaagcctgccctcatcatactgttaacttcgatatcatccccactacacagatgggaaaactgagaggcagataatagagagaatctgcctctggctgttccctgcccagaattttgattttgttcatctgagaggccagctcacatggtcagggccatggagagaaggtggctttgagctgggggatgcactgagagtcattttgtccagggttactcagaggagggtccagtcaacctgtcaaacaaatcttggtgggcttttcccagttctcagaagaatgctcttcgttagctccaatttactcaagttcacctttgccactcagttttcttcaaattttggtgcctggtacaactttgtttgtgctaaacgtgctatagataccatcagaatttattattatttttttaatctgggatgctttcctagatgtgtttacatgaacttggaaatgaacttttaaaattaatcttgtgactgggtgtggtggctcacacctgtaaccccagcactttgtgaggcagaggtgggtgaatcatctgaggtcaggagtttgagactagcctggccaacatggtgaaactccatctctaccaaaaatacaagaattagccatgcgtggtggcacatacctgtaatcccagctacttggaaggctgagtgaagcaggagaatcgcttgaacccaggaggtggagcttgcagtgagctgagatggcaccactgtactccagcctgggcgatagagcgaaactcagtgtcaaaaacataataaataaaaataaaattaatcttgtatttaagtgattttagtcaatgccccccatagcaacactagcattgactgcgtctaattcacttacccctgcttccccagtgcacccaatacatgttaataagcaaagccccatgatgagaatttgagtcccaattttacagcaatgaactctgaggctcagagaggttaagtagcttgcccagggtcacacagctaggcaactgcagagcgaggattcaagcccttgtctgtctgactctcaggctcattcttctgtgctctcagctgcctggtatataatagtaattatgtgtgcatttgtcgcaagaatgaaatcttcttaaccttctgctggggacaagctctggaacataatataatatcttggctattggaggtagccgggccttggggatgttctaaggagtattgtcctgcccagtttcctgatgagggatatgtaagcctggagaagggcagcagttgagcaggagttggcatgggggtggctgatggctggtagctgtccacagccatgagccagtgtgtcatgtccacagctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttggtgggtgtgtccccaagggagcggggggatcactgtttttcctcttcccttccaaagtctggtagggaggaggggctctcctggggtttcctgaggacttcccagactcccctttgagccaggttggtcctttgcagggaaaatgctgagtgtgaaggtgatgagggacaacagcggccactcgcggtgctttggctttgtcaactttgagaagcatgaggaagcccagaaggtaggagcctccccatggctctgttctgcagcagggggaccgagctgggactaagaagagggtcccagctgcctgtggaggggaagaaagtccctccccggcctaagccaagagggtgggagagtcctgtgtgcaggcaaagcccttccttctgtggtcaaaggccaagggcttcattctttggtcacttctaagccctgatgtccgcagagctgaatatttaggtagggatgcagaagtcattattatataaaaatatttactcatgaactgaccacttaaatcagtttccaccgggtgtggtggtgtgcacctgtagtctcagcctacgtgataggctgaggcaggaggaccccttgagcccagtggtttgagtccagcctgggcaacatagcaagaccctgtctctaattttttaaaaactctccagatgtgatggctcatgcttgtaatcccagcacttggggaggctgggtgggaagactgcttgagttcagttcgagaccagctggacaaaacggcaagatgccatcttcacacacaaaaaggctctcacagttagcaaagaggattattttgtgccttgaaatccaactcaaagtaaggatgttgatgatgctgtcatgccattatgagagaattatgcttgctactttgttcaaattatccatgtgtagttgcagttagaacctaaatttttttaagttctttaagttcttttttcagtgtagttttaagttcagagcaacgtttagtggaagttatggaggttttctgtataccccattcccccaacacatgaacagcctctgccattatcaatgtcctgctcccaagggttacgtctgttacaagtgattcacttactttgacacatcattaacacacacagtcccaagtttacattaggatttacttttggtgtagagtctaggggtttggacaaatgcataatgacatgtatccactattatggtatcatgcagactactttcagtgccctaaacatcccctgtgctccatctgttcattcctccatgccccttaacccctggcaaccaatgatctttttgcttgctccatagttttgccttttctgggacagagactatgtcacctagactggcttctttcacttagtaatacgcatttaaaatatgggaatatataaatatttacattttattttatttttatttatttatttttgagacagagtctcactctgtcacccaggatggaatgcagtgacgtgatctcggctcattgcaacctccgcctcctgggttcaagtaattctcctgcctcaacctcccgagtagctgggactacaggcgcccgccaccatgcccggctaatttttgtgtttttagtagagaaggggtttcaccatgttggccaggctggtatcgaactcgtgacctcaagtgatccacccgccttggcctcccaaagtgctaggattacaggcgtgagccaccatgcccggccatatttacattgtaaatatgggaaaatttgcaaatctcaattttatttttatgtttattttattaagatggagtctgtctgtcgtccaggctgtagtgcagtggcgtgatctcagctcactgcaacctccacctcccagtttcaagggattctcccacctcagcctcctaagtagctgggattacaggcacctgccaccatgcctggctaatttttgtatttttagtagagatggggtttcaccaagttggccaggctggtttcgaactcctgacctcaagtgatccaaccgccttggcctcccaaagtgctgtaattaccaggtgtgagccactgtgcctggccatcaattttgtttcttaaaatacagccccagtccgaattttttttttttttttgagatggagtttcactcttgttgcccaggctggagtgcaatggcgtgatctcagctcaccgcaacctccacctcccaggttcaacgattctcctgcctcagcctcccgagtagctgggattacaggcatgtgcttccatgcctggctaattttgtatttttagtagagacggggtttctccatgttggtcaggctggtctcgaattcctgacctcagatgatccgtccccctcggccacccaaagtgctgggattacaggcatgagccaaagtgggtatacttaaatggcctttgtcctggtactgattattctcagctagtgtggccagcctggtttgcaggtggcccctctagatccagaagatgagcctgggccagggccacatctgagtggttaccaagcatgttccctcctcctttccccaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccaggtgaggtcaggcttcctggtggcagccacttctgtgtgagagcagctgtgtgtcgggggccctgagtggtgactgtttcttctagtgatcctacttctgggcacttggctcaaggcgggaattgaatgagcatgggatggcccccactgcctaatgtataacagtgagaaactgcgcacaacccaactgtccaaccatcataggggttagtaggggtgctggggaccttttggttagaataatccttcacgtgggactggttagcatcccacccagcccactcaatcccagttgcatcctctagtctcagacaaccaaagtaccccgcatattgccagatgcccctagaggaaatcctactcctggctgagaataatcaggccaaatatgttacatccaaaagttggaatgttggacagcctttgaattatgtggagttaataattaaagtgaatattgtggatcagtgcaatttaaaacttcattgggaagtgaacccctctaagattttatttatttacttattttttgagacagagtattgctcttgtcacccaggctggagtgcagtggcatgatcttggttcactgcaacctctcactcctgggttcaagaaagtctcagcctcccaagtagctgggattacaggtgcgtgccaccatgcccggcaaatttttgtatttttagtagagacagggtttcaccatgttgcccaggctggtcttgaactcctgaccttgtgatctgcccgcctcagcctcccaaagtgctgggattacaggtgtgagccactgcgcctggcctcatttttgtatttttaatagagatggagttcatcatattggtcaggctggtctcgaactcctgaccttagttgatctgcccgctttggcctcccaaagttatgggattacaggcatgagccaccacgcctggccccctctaagatttttcataaaagttctagatccttcatggagaggggcatataaatatacatatccacacaaaacacgcacacatactcagtagttctcagtgaggagcagttttgcctcctgggggacatttggcaatgtctagaattttcattgtcgtgtgggtggtggggtgctactgtcatccacagggtagaggccagggatgctggcaggcatcctacagtgcccaggacaatgccacagcaaggaactgtctggcacaaaatgtcactagatctgaggctgagaaacacatacatcctcttgtgtacatacagcgtgtccaggggctttcatacctgcagaacaaaatactcatcacataatctgcaagagcaggatgctatgctgtacaattgtgcggtctctgttctcttgtacattcatacactgttgtgtttgggaggtctggaaggagaaaagtcaaggtgctagaggcagctgtcactcaacagtgagatgcacagactctgaagttagtctgcctgggttgtcctgtctctgccacttagctactgtatgatctggggcaacttatttagcctctttgtgtttcagttttgtctgtaaaacaaggataaaagttttcttcacgcagggttgttgtgaggattaaaaatcaaaacgtggcctgtcgtggtggctcgtgcctgtaatcccagcactttgggaggccaaggtgggcagatcacctgaggtcaggagttcaagactggcctgaccaacatggagaaaggagaaacccgtctctactaaaaaatacaaagttagctgggtctggttgcacgtacctgtaatcccagctacttgggaggctgaggcaggagaatcacttgaacccgcgaggcagaggttgcactgagccgagattgcaccattgcactccagcctaggcaacaagagcaaaaatccatctcaaaaaaaaaaagtcttaaaaaaaaaatcaaaatgtatgggaaagcttagagtggcacctggcaccaacatgagtaagtgcccgaggttcctgggctggcaggggatggaggggcagctcacctgtgttagggttctggtcatgggccagccagggaggagctctgactcctgctgcccgacatccaccatctggagagcttggcttgggcatgctctgcacctcagcctgccacgggacctgggacatcctcgtgggccccatctgtgaaatggggaatagctgtggtgaggctgggaccagtgcagatgtgtgagaactgcaggggaatttgggatgtgggggctacagcttgcatgtgatgggcacgctgagggatgggggtacctgggtgctgagggagacggggagcaggaggctgggctggtggggctccccatgccccttgtacctgcgtcagttccctgatctccccaaggcagttggggcttggaggagaaggggacatccagcagtttcccttccatcccagggtgtgaacttgtatgtgaagaatctggacgactccattgatgacgacaaactgaggaaagagttctctccctatggagtaattaccagtgcgaaggtgaggactgggggcacctccgggggacagcgttcccctccatcctctcaccaccatccccccacaaccccacccctccaccctctcgcccagcagccttcagggggttggtgccggctaccccttctggggctctgctgaccccgttggagcttgtagccatctgcagccttgtctgggctggaggggaagagggtagaaatatagtcccagtcacacagctggacttggggctcactgtcaccttggcatttattgagtgcctactgtatgccagattccagaaattcatatcttagtatttccattgacttttgttgtctggcctctgccagtgacattaccctcctgggcctccgttttcccatctggaaagtgagagggctggacttcgtcattcttcatttgttcttccctatttctggagcaccaattgtgtgcccaaccctgttaggcccctgagatgtggcaactggcccatcagcagctctatgagctttagcagatgttgtcttatagataaggacactgggctcactggatggctttccgaccctggcttctcattacaaccccctgggcaattcttaaatacacacacctcagtcaggcatagaatgtggatccccggggtagggcctgggctttttattttttttttttaaagctcccagaggctgggcaatatggctcacgcctgtaatcccagcactttgggaggctgaggcaggcagatcatgaggtcaggagatcgagaccatcctcgctaacacggtgaaaccccatctctactaaaaatacaaaaaattagccgggcatgatggcacgtgcctatagtcccaggtattccggaggctgaggcaggagaatggcatgaacccaggaggcggagcttgcagtgagccaagatcgtgccactgcactccagcctgggcaacagcgagactctgtctcaaaaaaaaaaaaaaaaaaaagcgcccagatggtttttaagatgatgatccagtgtttcttcattctatacttaaatacctgctgttttaccaggctctgtgggaaacaggagcaaatcagatgtgatccttgctttcaagtagcttatagtctagtgaggaagtcagcccgtcactaactcaaatggattataagatgggggacagtatgggaggcaaagctacaggagttcagtggaacagaagggaaggctgcctggaagaagtggcagtagcagcagtgtttgacttggctgtgaggaggtagggagctggagtgggaatgaggaattttccaaagagatcagtgtgagtgacaggatggggggacccgcctgaatgatgtgatgttgggttctgaggaagtggtctagaagttctcttttggctactgagtccagttgtaaacatccttcagggagccttgtgtttggaggaaaaaaggttgtcttttaggttaagatccttttgaaaaatgcgagagaaggctgtggcacatgtaaattaggcatcagtaaatttgattacacatcataaaaagctataggtcctctttccaagcaaatgcatatacatttgatgtagaaacatggttgaaagctggaattttaaagttaatcaggtttaaatgtaaaccccagtcctaccattacctagctgtagaaactgaggcaagtggctttgcttttcggaccttgtttactcacctataaagtgggagcaacatttctcacctctccaggtgtcctaagaactactaaagaggctgcatgtacagcatctgcattcaataagtagtgaaatagtgattgtcgtaatgattcatcatacaccttgcatacagcttcaggagatggaccttcttgaggactccccgaacaaaggaaatgtgtaaatttggattgcttagagttaaggcacacctggggtgaccatctttttaacaggacaaacggtataaaatggggattataaatatatctattttttgtgtgtgtgatggagtctagctctgttgcccaggctagagtgcagtggcgccatctcggctcactacaacctccgcctcccgggttcaagtgattcttctccctcagcctcctgagtagctgggattacaggcacctgccaccatgcccagctaatttttgtatttttagtagagacggggtttcactgtgttggccgggctggtctcaaactcctgacctagtaatccgcccgcctcagcctcccaaagtgctgcaattacaagaatgagccaccacgcccagcctacatatatatatatattatacaattatttatttattttgagatagagtttccttcttgtcgcccaggctggagtgcaatggcgcgatcttggctcactacaacttctgcctcccaggttcaagcaattctcctgcctcagccttctgagtagctgggattacaggcgcccgccaccaagccctactaatgtttgtatttttagtaaagatgaggtttcaccatgttagccaggatggtcctgaactcttgacctcaggtgatctgcccgccttggcctcccaaagtgctgagattataggcgtgaaccactgtgcctggcctatgttatgcgattttatatattttggtttattattattttttattagatgcaggttcttattctgttgcccaggctggagggccatgatgtgatcatggcacgccacaacctcaacctcctgggctcaagtgatcctcccacctgagcctcctaagtagctgggaccacaggcatgtgccaccatgcccagctgatttaaaaaaaaatttttttttggtagaaattgggagtcttgctgtgttgtccaggcttgtcttgaactcctgggctcaagcagtcctcctacctcagcctcccaaagtgctgggattataggcatgagccactgcatctggcctgtattttgttttatataaaaataattatgaaaattaaaggaattaatggatataaatacttataccactatcaagttcatggtaagctctgcataagtgttagctttgctaaattttatcattattaactaccgactgccagaagttcttaacaatatatatatatttttttttttttgagatggagttttgctcttgttgcccaggctagagtgcaatggtgcaatcttagctcactgtaacctttgcctcctgggttcaagtgattctcctgcttcagcctcctgagtagctgggattacaggcgcctctcaccatgcccagctaattttttgtatttttagtagagatggggtgtcactattttggccaggctggtctcgaacttctgacctcaggtgatccacctgcctcagcctcccaaagtgctaggattacaggcgtgagccactgtgcccggccctttggctatctgatgaagcctgtggaacccttctaagaatattttttaaaaacttttttgagacagagtctcgctctatcacccaggctggaatgcagtggtgccatcacagctcactgcagcctccaactcctggcctcaagtgatctcctgtctcagcctcccaagtagctgagactataggagcaccactatgcctggataattattttttatattacccaggctggtctcaaacccctgggctcaagcaattcttccgcctctgcttcccaaaaataggcatgagccaccaaacctggccctaagaatatttttaaatgcataaaataagattcttaggtgtacaaaaaaatcatactgaaaaaatataatggtcaaaatactaaagtgaaagcagtatgtgcttcttttattatttttatttttatttttttgagacgaagtcccactctgtcgcccagactggagcgcagtggcatgatcttggctcactacaacctctgcctcccaggttcaagaacctgggttctgcctcaacctcctgggaagctgagattacaggcacccgccaccataaccagctaatttttgtatatttttagtagagatggggtttcaccatgttggccaggctggtctcgaactcctgacctcaggtgatctgcccaccttggcctcccaaagtgctgggattacaggcataagccattgcgctcggctgagattagcaataattaatgtgatatgaaaatattttctttttcttcatgacaaattcatggctaatactgccaggatttttttgttgttgcccatattcataatagaaggaaatgctaatatgaaaataaagatgtcactttttccccaatccatgcaatttccccctaaattgtatccatgacctacctgagggggatccatggactctcaggttaagacccctctactgaagggtagcagagtacagtttcaaaattactgattaagagcgtgggctcaccaggagttcaagcccagccggggcaacaggatgagacctcatctttacaaaaaatgaacaaaattaggcatggtggtgcttgtctgcagtcccagctacttgggagactgagttgagaggatcacttgaggctgagaggttgagggtgcagttgagctgagattgcaccactgcactccagcctgagtgacagagtgagatcctgactcaaaaaaaaaaaaaaaaaaaaagaaaaaaaaaaaggaaaaaaagaagattttaaaaataactctagtccttatgggctgtatgagccaggccggtgtcttcaccctaaaaaaaggttaaaaacccagggccaggtgtggtggctcctgcctgtaatccctgcaccttgggagacctaggtaggaggatctcttgagaccagcctgggcaacatagtgattgctgatctctacaaacttaaaaaaaaaaattagctgggtgtggtggcatgtacctatagccctaactacttgagaggctgaggcaggaggatccctggagcccgggagtttgaggctgcagtgagctatgatcataccactgcactccagcctggatgacagagtgagaccccatctctttaaaaaacaaacaaataaacaaaaagacaaaccctaaatgccatgtgggttggatcctggaagagaaaaagaatattaggggaaaaaagagtgaaattccagtgaagtctggagttcagttaatagcattgtagttaataggagctaatggtataaaatagttaatagcattgcaccagtgttaattttgtagttttgaaaaatgtaccatgttcacattgggggaaactgggtgaaagatatacagcaggccaggcatggtggctcacgcctgtaatcccagcactttgggaggctgaggcaggcagatcacttgaggtcaggagtttgagaccagcctggccaacatggtgaaaccctctctctactgaaaatacaaaaattagccaggtgtggtggcacacgcctgtagtcccatctacccaggaggctaaggcaggagaattgcttgaacccgggaggctgaggttgcagttagccgagatcgtgccactccactctagcctgagtgacagagtgaaactatgtctcaaaaaaaaaaaaaaagatatatagcaaccctctgtactgtttttgtaactttttctgtaaatctaaagttactccaaagtaaaaaggttattttaacaaaaaggctaagaacctcttccccaaattcctaaagaacttggcttggtacttagcagaggcgatagaagcttaccagaacaatgtgttgggttgagtcctggctaacgtatgaaccacaggctgagtgaccccagacaagtcactctttcgagtctctcttatcccggctgtaaagtgggagccgcgatgcctcccgcatcgggaggttgtacatgtgaggtgtgaagacatgtaaagtatctggcatgcagcaggcctcatagatgggggtgcgtgctgcatccctcaaacagctcagtaaacagggtgcacgctacatccctccatcactcctcagtaaatgggggtgcacgctacatccctccatcacagcttgctaaacgggggtgcacactacatccctcgaacacagcttagtaaacaggggtgcacgctacatccctccatcacagctttctcgcgggcctgcccagtgctgggcttagcccatggggaggagggaggcagcgcagccccaggagccttccttccccaccccagcagctcttgtcttgtcttgcttttaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttcctcccttccttcccttccctcccttccctcccttccctcccttcccttcccttcccttccctccctccctccctccctccctcccttccttccttccttccttcgtggggtctccatgtcacccaggctggtgagcaatggcgtgatcatggctccttccttcttccctcccttcctcccttcctcccttccttcacggggtctccatgtcacccaggctggagagcaatggcatgatcatggctcactgcagccttgaattcctgggcttgagtgatcctcccactgtagcctcctgagtaggtgggactacaggtgtgtgccaccatgcccagctaatttttttgtttattttaaagaaggggtctcgccatgttgcccaggctggtctcaaactcctgggctcaagcaattctcctgccttggcctcccaaagtgctggcattacaggagtaagccaccgtcccccgccctacatttttttaaaaattaaatttttatttttttggagacagagtcttgctctgttgcccagaatggagtgcagtgacaccatcttggctcgctgcaaactcttcctcctgggttcaagtgattcttgtgcctcagcctcccgggtagctgggattacaggtgcgtgccaccacactcagctaattttttgtatttttagtagagacggggtttcaccatgttggccaggctggtcttgaactcctgacctcaagtgatgtgccctccttgacctcctaaagtgctgggattacaggcatgagccaccatgatcggccctaaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtaggtgagtgtgggtagggccaaggggaatgggggtggggcaaagttggcactaggagtcaggaccagcctccatggtgaccttgccatatgccctctcggtgagcaaagctgactttggagactgtagcgtggtagttagcttggcctccagttcctgggaccaactgactatgaggcccttgctgactactatatctgtcacctaatctttaaaatggggacaaaaatagtacccccattttattgtagagaatttaaatgtttttttttttctttttgaggcagaatttcattcttgttgcccaggctggagtgcaatggcatgatctctgctcactgcaacctccgcctcccaggttcaagcgattgtcctgcctcagcttcccaagtagctgggattgtaggcatgcgccaccatgcctgggtaattttgtgtttttagtagagacggggtttctccatgttggtcaggttggtcttgaactcctgatctcaggtgatccgcccacctcagcctcccaaagtgctgagattacaggcatgagccactgtgcccagccttaattttttttttttttttttttgagatcgagtcttgctctgtcgcccaggctggagagtaatggtgtgatctcggctcactgcaacctctgcctccggggttctaagcgattctcctgcctcagcctcctgagtagctgggattacaggcatgcgccaccatacttggctaatttttgtatttttagtagggacagggtttcaccatgttggccaggctggtctcgaactcctgaccttaggtgatccaccagcctcggcctcccaaagtgctgggattacaggcatgagccaccatgcccggcttgttgttgaggatcaatgagatcatgcatgaaagggcttagcactgggcctaaagcctggtaagtattgcagtgactataaacaagggtgtaggttttggctgtacagcaagcacatctgttctttcattctgcaaatgttctcacatccacagtgtgctggggccccaagctcagcactggaggttctgcgtgaacgaggtatactcagtctctggccttaggttgctgccaggccctgacacccctgcttattcctttttattgtggtaaaatacacataacaaaatttaccacttaactatttttcagtgtacagatcaatggcattaagtatattcacactgttgtgcactgtcaccaccatccactctccagaactctgttcagcttgtagagccgaaattctgtacccatcaaaccataacttctcgttcctcctcccgctagcccttggcaactgccattctactttgtctctgtgaatttgactgttcttgcttggtacctcatgtaagtagaatcatagagtatttgtctttttgtggctagtttttttactttacatgtctcaggatgtatctatgttgtggcgtgtgtcagaatctccttattaaggctaaataatattccattgtatgtatagacctcatttttacttattcattcatctatcaatggacacttttctaccctttgggtattgtgaataatgctgctgtgaaaatggttgtgcaggctgggcgtgatggcttacgcctgtaatcccagcactttgggaggctgaggcaggtggatcatgaggtcaggagttcgaaaccagcctgaccaacatggtgaaaccctgtctctactaaaaatacaaaaattagccggacgtggtggcatgtgcttgtaatcccagctacttggtaggctgagacaagagaattgattgaacccaggagggggaggttgcagtgagccgagataacaccactgcactatagcctgggtgacagagcaagactctgtctcaggaaaaaaaaaaaaaagaaagaaaatgtttgtacaaatagctctttgaaaccctgctttcaattcttttgggtatatacccagaggtaaaattgatggatgatatggtaattctgtttaactgtttgagaaagccctatactgtttttctgtagtggctacatcattttacattcctaccaacagtgcacagtcttctaatttctttacattcttgtcaacgcttgttattttctgttttggtgttgttttgttttgttttgtttttggatagcagctatttgaactctgctttttttgttttgttttgttttgttttgcagccaacattggtactcagaccacaggacccagtggggtaggatgctgtacaccaggccggccgctcctgccgtgcaaatgttcctcagcagcacatagcacctatcgggtaaggccagcccagctgcctgctcttagcctgggctcctggccgcctggctcagaaccttagctaaggtgttgggccttggctttttttcttttcttggcttgtaaagtttcgtttattaatgtgtacaatcaataagagatcacccttactgcgagaaggggaaagagggccagcattacgttttatttacaatttgttttgcttcggttattaccaaaattaatttggatatccttagtatttgtgatgaacaccaaggaaaggtattctaagaatatgctgattattgaagggatgtacttaatcttcaaaacagaaaatacttactgtaatcaaagactgtgtatttatctccctcccctaaaaaaggcctaaaattcagcattatcatatcctgtgtagaatttcaatgtgtctcttttgaactatttcctgcaaaatgaatgagaacagtctttaaacagcaaaaatgtctatttttttttttggacagggtcttttttttgacagcacccaggttagagtgcagtggtgtgatcatagctcactgcagccttgaactcctaggctcaagtgatcctcccacctcagcctccaagtacaggcatgtgacaccatgcctggttaattttgtgtatttttttgtagtgacaggggtctcattatgttgccaaggctgatctcaaactcctggcctcaagcgatcctcccactttggccttccaaagttctaggattataggtgtgagccaccacacctggccaaaatgttttaaaattaccaagatgtgaaagggtgagaggtgtgccggggacatgtccataaatctacttgataaaaagtgctttatttggcacaaagttattggtaacacagggctttcctttatcaacgttcatcagggacctttataagttcgtagcactacaggaaacgtctaagctagaggcatgactttgtcttctaatccactttgcccttgttggggactctccaccccacctgatcatccagaccttgccctctgttcccctcctccagtgcctccctggccttctgctcacttgccagggtaagtattttgaggacatgcctgtccatggtgattaagggatgtgtccccggcaccatgcaggtccaggagccggctgtgcacatcccaggacaggagcccctgaccgcgtccatgctggctgcggcgcccctgcatgagcaaaagcagatgattggtgagtggctggttctcctactgtggagcaagaagaggagggctgcgagctggctagcctgctgggaaacacctcacctggtggtccaacgtgaggtcaaattccagctttgtcaccgacccccctactgggtgaccgtggccaagctggctctattctctaggcacctgttatcttgtcttaaaacgctggtcagactggatggtcctgagctttcttccactgctgctgtcctgtgactttgaggttgggagacagtccagatgtggggagatcaggggacaaagggaggagtaggggtatggtcttgggtttctgctgagaaatggcttgtaggtggggggttaaagttcctcacacctctcctgaacgggaggaagctgctgttcaccagtttccagtgctcaatgcgggcaggtggggcatctgtgcgtttggtaaatacatgatgtttcccatagattctggattccttgtgcaattcatcttcacccctagtgtccatggcaggccctgataaaaatgccactaagtgaacacaagcttgttcctggttggcaggttctttactgcatggcccccgagacctccagaccctttactgaaggcccccattaccactgccccattgtttcctcagcttacttagggttttgccacattaccccttcccctcaccccgaaatttttttttttttccctgagatggagtcttgctctgctgccccggctggagtgcagtggcacgattttggctcactgcaacctccacctcccgggttcaagtgattctcctgcctcagccttctgagtagctgggcttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacaggggagcgtctctacccccttatccatgatgtccacacccagctggctggcaagatcacgggcatgctgctggagattgacaactcagagctgttgctcatgctggagtctccagaatccctccatgccaaggtaagcaggagcctgggcagcagggagcccgagggggcaggaggagagctaacgacaagggctctcctagtggagccagtggatagctgtttggccagataaagtgtttcttcttgctaatacctgaaggcctgctgaatcttaagagtggaaggggccttaggtaagggtttgctacttcagcccttccgtagactaattctgtgttgttctgtaggtaggtcttttggtacaaggaagtgtgttgtgactcagtgtaagggttaagatttttccagctgtccagcaatgtacctctgtgtcaaaggtgacagacagggccatgggatcttgcaagcagtggtggatgggagggttccacagaaaccctgtggatggaggaggatcctgtatccaggatggtgagcgagggggagatcaaggctcttctgtgacctgctaagatagctgcactaagcccccccgccactcatgtctcacagatagacgaggcagtggccgtgctgcaggcacaccaggctatggagcagccgaaggcgtacatgcactgaaaccaggtgggtggaatggtgacagaagcagctgagcccgggagaagctgtaaggaaataggcagggactgactttcacaaacactgagaattgcgccgtgttcctggctttctctgaagcaccaaagagtttggaggaagttgtgagaatcagaggagatgattaactgtgatcggaatggggggtggtggagggtgaaggaggtgccctcttgccagctgccctgcctggcttcatgcagaatagtttgggctttcccagggccctgcctggctccattctgcctgcctgaaggcctggccaggatgtaaccaccttctttattgaagactgggtgtctgccatactttaaaaacacttatttttacctttttgtcctcagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgccttgcctcccaggaggcccttttgtgtctgagggaggtggggacagagcaaacggtagacatgactggggtggggctcaggctctaagaaacagaaaccctaaaggagtgctgaagtacacagagggcatatacacaagagcaggagaagtgttaggaactgacccatcaacagtacagtggatgatgacatggatatcacacaatggaccagagctacaggggcccccatctgatgtgcatgcagcccctggcttgggcaccctgcagggcaaacacccagctgcttctcggctggctaaggggttgtgtaacataattaacccttgtaggaacgttttagggtaccttcccaggtcaggattttcctcccctaatggagaagtctctcgaaaagcttctttgtgtcagttagtgctcacctcccatcagggacgtacagtccaggtctttgccctctcgtgtaccggagcggcccagtgaaagtggctactatgacccaagcagactgggttctgctaaaaattcaccagcaacaaatctgaccgagtcctcaaggctgctctgccactctcagcaactcactcttcctgttctccgctccacagacctccaacctgtcttcaccatgtcctgcccacttctttggctgcttttaatctgttccctgtgcagctccatcgtcttctccccaaatcctgactgctggcatttctttactctcagtcctgggccctctcggtttctcatgccatgttctcctgagctatctaatttacaagcgcatcttccatttgtacccagtcgaggatgactccctgtttttttcttcagcccagtcaactcttaagagcacctgagtcacctctcttacattccaccgcctacctgccatcagctcctggttatcttggtaacactcatgtctaaattcaagcttatgatttaactaagtttctttctttttcattccttggttcttttttttttgagacggagtctcgctctgtcacccaggctggagtgcagtgacgtgacctctgctcactgcaacctccacctcctgggttcaagcagttcttttgcctcagcctccagagtagctgggactacaggtgcactccaccacacccagctaatttttgtatttttagtagagatgaggtttcaccatattggtcaggctgatctcgaactcctgacgtcaggtgatccacccgcctcgggtggggtttacaggcatgagccaccgtgcccggtcttattctctgattctctcttccagtgttctgtctccataaatggccccaccattctgttgcaaaagccaaaatcagagggtttccccagccctgctgccacaccactttctctcctcccctcttccagagaaaatccaccaacatgacctcctaccagatccaaatccactaccactacctagtggaataaatccactaatttgagctaagctcaacccctgcgctcactgccttctgccagttaactgcatttaccctggccctcccgcagtctgtcctccaccatgcagtcctaaggcttctttcaaaatgcctctctaatgtctcatccttgcataaatcctgcagtagcttcccatcattagaataaggactactttacacagcctaggagaccctgcatgatctgctctctgccctgtcattcccacgtaacggtgttttaccttctctgggagtcggggtagaattccatcatgaccattaagacagtcacattgatagctgtgtgtccct

SEQ ID NO: 82 - DNA, 232406 bp, Homo sapiens
agtgaatcagaactctctcctaggactgtggactaaagacattaagtaaaggattcagttgctgtgaggccacgttgcaaggtcagtgtcaaggctggaatcagcacttggggttttggtagagaagcatcctcagctaaagcttttactttttcttaaattcatccttatcagacttttaagatagatgctcagggatcccagggtcagatgaaagtaggagaaatctattgctgctatgccaggatcaccaggtgagccttgagaagcgctggaattcatagagtcatagctcagcaaaggaaaagaggagtccacagagtccagccagtgatgcccgtatagctgagaagggtacagaaaggtgagggcagtgtccagatgactgtccctcaccatcctggtcagccccctaggtgtacaggtgcacaggtaggaagtcctgagcttactctgtgtgggaaagccaaggttttgttttctgtttttttttgtttgtttgtttggaagcggggtctcactctgtcacctagactggaatgcagtggtgtgatcttggcttactaaaacctccacctcccaggctcaggtgatcctcccacctagcctcccaattagctgggactacacaggcacatgctgccacacctggctaatttttgtattttttgttgagatggggttttgccatgttgcccaggctagtcttgaactcctgagctcaagcagtccacccacctcggcctcccaaagtactgggattacagggttgagccattgtaccaggcctgggagccaaggttctacatacagatttttaacacagaattcttaaagctaacaaaatatcaccaacaccttattaggggaaagcagaatgttcccttataagtaatttactattatgaagtggtttggtgagggtggggggttcaaggtgacctggccagaaaattgggctttttctagctttacacatggcaaggcagagctacaggggagtcaaagttagtgagaagcaaaaccttaagagtgtttcagggggggtccttttccagattggacaacagcgaactggcctttctttcctgatagtcacagacctcagccctgcttacagagtctgtgcacaaattatctttgtgctctatagtttaccttttgacttaaagagtcaattttcacctcactttcacgctaaaacttcaccccaaactgaacatggaatgtacgtttcatatatgtttactcactacacacactcctgacttcccttatgaatattcatagatttcctccaaacctgatgaatatgtatgtaaggctaaccttgcaaggcatgaatataccagctttcctttcccttccatggagcacatactttgttttccttggaggtggcattccccaatatgcagattatttctccctctgaaaataaagttttctcctttccttcctccatgaggcttttttgtttacaatcctcatcctctgccatatgtcttctgctgggttctcctaaagtagacctggagttcgagactcatgtgtaaattgtctgttaaggaagtgttccctggagggcatggagaggaggaagaaacgagacagggctgtgatatttatttattttattatactttaagttctagggtacatgtgcacaacgtgcaggtttgttacatatgtatacacatgccatgttggtgtgctgcacccattaagtcgtcatttacattaggtatatctcctaatgttatccctcccccctcccccaaccctatgacaggcccaggggtgcgatgttccccttcctgtttccaagtgttctcattgttcaattcccacctatgagtgagaacatgcggtgtttggttttttgtccttgagatagttggctgagaatgatggtttccagcttcatccatgtccctacaaaggagtgaagtccgctcctcagcttgatgccatggggcgctctggagtgggaattaccccacagtttatcccatctcaagacaaaggagtgggactttcacactcccacacccttagtagttagtgcacgggcaatcactgaagaagggaacacgtgctggccattaggagccaagcatggagaagctgtgagacactgctgaagggattttgtaggcacgtaggtggaggtcaaccagaagacaagtgagccgggatcagagctacccagccaacctgcagctgtgtgagaagggaaggctttttggcctgtaccagtgagatttttttgttgtttgtcatgcagcattattgcagcagtagctaacggtaagttattgtgattttttggctccttatggttttccagtgctttgaaatgcagctggacattctgctgctgggttctgtggcatacaaaggatcctaattttaaaaagcaaaacaaacatttcgacttcagctagtttaagccgtttctctttccttgcaaggaaaagatttcccacctatcagctatgcagctgcggtcgttcaggttaagatatgatttaacatactctgtggcttcttcttggcttagaatatttctagacagtttttgaaagaatatcccttgagcttaaccagcccaaggtacactcaactcctttgagtcttcatccaggatgtcagctttacctgtgggtcctggcaattaagtaaccttttatgagagtcctgtaggggcccggaggagctgggctctgtgtattgatgaaaggaacccagtgcttcctctcctcagaagcttgaatggcagaagtgttcgcagccttgagctaaagcagggataaatcattcactgtgggttttttttattataaaagcccagatgggcttcctggtagaaggtggcggaaacagagctgtctgcctccaaagggcacctctctatgtcttcattcccaaagtaggtgcataattagaaatcctgcaattcttctttaaaacgtctctaaggttttccttaagattgtcattagtgccttaaattgtagcataacttgattttcgtgattgctgacacctcatactatcagaatcaaggtataatttcccctgaagtattaatgagaagaaaagataaggccactttgacttcctcgaagcatccctattctttttctctggcgtgttgctgttcttttcattttaatttttaagaaacatccaggctttttgctgtaattgcaaagcagggaattgagttggttttggactttattagtctgcttatgggttacaaatgttttggacaattgtttaaattgtaaattcatgatcttatttctttttcctctctgtttaatttccttttctctttcttccttggttatgaaaatgggagagttctctgaacccccttgcaggatgtgtggcttatctgttcagccttcatgtgcactcaaacccccttaagggagggagtgcatgcagatgggcaggtgcaggagcctgggcgagtgcccctgggctctggccccacagcagcatccaggggtgggtacctaaggctcctgaagcccaagtgggcatgtgttacagtgtgctctcttagctttgccgtccatggacagtgttaaccagcttagtaccctcttggtacccgggtcctggtccagaatccaggaagaatcaggtcacacacagacttgaaggatgaatgcaggggttttattgagaggtggaagtggctctcagcaggatggatggggtgctggaagggagatggagtggaaagatgatcttcctctggagtttggatgtccagaggccgatctcctctccgactgtccccagtcgaactcctgtcagtgttcagatactccttctcttctgtctgctgcacggttctgccatccatctgtttttctgttcatctcctcgtctgctcatctgtccatagagcctgaggtttgagggcttatgtgggtacagggtaaggggtgtggcaggccaaaaggcaacttttgggtgcaaaaataggaatgcctgttctcaattcgggctgtgggtttccaagtttgagggtgggatctttgccagagaacgtccctcttctacactgtatttccctgtcttctgtccatgtcagttagagtgtaagacatttggtcagcaaaattaactagatcatgagtttgagaggtagctcaaccaaggtattgtctctttattataattgccagtttttcatctagtccatttataaattttgagttaaggagaatataattttggtgattagaataactttcttctgatgggcctgaatattgttgaaatactttttcaaatctctcatagtatgatattataggctcatcaaaattttgttggcattgctgtattttactccaatcaactactgttttgaaaactaagggaatagtatctagtaaagacttggcagtactgcaggcccattcatgatctgcttcagaaaatttatgcaagtttttcacaatattcctgcagtttacctttgctacccagtcttggcttttctttctgatattaacatgtgaaccaattggtatatgtcagaaaatccagccagagtcataagttcaaatatttagttcaaattctttagcaaattcaatcgagttctgaagaggatacaggaattctttacatctttaagttccacttttgaccataatcaataaccaaggcagattctcctctatcagacacagagtattcccagaatggagccagaacagcagaaggtagaggaggaaagagaagtaagtttggacaaggaagttctggcaaaagaaaagaagatgaagaagggggaaaattttgggcagtcattttcaaatcagaaagtgttttagacaatcttttgttttccacttgcaaagaaatgactattagaacctgtctagaaacttctaagtaccattgaaaataggtaccatccccagttattttattttagggcttgctttttgtaattgactgtactgataaactaggctaggtatttcaaaggtactccatgtggaccattgtaatttggggtctctgggagttatgtgagaccatttttctaaatatttgcatgaagaaatgctgtaagtattacacataagtccagttagtgtttctaaaggtgattctctctgtaaggaggaagactcagttttagaagtataattgcccacaatttagatcttcctttcgcaagagcaaaaatatctaatgggattttgttttggatcaagtgtgcagcttataggaatagctcctcaaggtgtcagccttgagtgggttcttcccttttacatgtcttggtggttccaagaaacttggtgcttaaggcattagatgaccagcctttatgtgtgtccgctgggttaagcaatgctccctgcatgttcttcttaaaagacttccgtgagactgttcacactgtaagtgattagctccaacattcccacaagaccttagccacctaaggtgccttttggttaggaggaacagtgtcttattttgtcctcttcttattttggtcactcaagaagaaagtgtagatttatcagttgagccaagcttcagaatctggccagcttttaaaattacactttttatttatttttatatttttgcttaagccacaaagatccacttcctctttccagagagaaactgtttccccactgactaaaattctgaatgagagaaaaggttgaaaatcaaaatctctaatgaataattccaaaacaaccccttaatctcagagaaaagtaaaactcacaaattcatgattagcagaatctctagagagtaacaaatgaaactcctagcttgaggtagagcttcaattccaactccgttgagttaggaatgtgtgtagctcaaatagtctgaatccgcaagcgagcctgggatgatttggaccaagaggggccttaccagagatctccattgactcttgtgaaactgggtgaatgaaaatcctttgcgttggtgctgttaccagaaaggggtcctgatccagaccccaagagagggttcttacatctcatgcaagaaagaattcggggtgaatccacagagtaaagtgaaagcaagtttattagagaagtaaagaaacaaaagaatggctactccatagacagagcagccctgagggctgctggttggctatttttatggttatttcttgattatatgctaaacaaagggtggattattcatgagttttccaggcaaagaacctggagttcctggaactgagggttcttccccttcttagaccgtaaagggtaacttgcagacatggccatggcatttgtaaactgtctgtggcactggtgggagttctttagcatgctaatgtattatgattattgtataatgagcagtgaggctgaccagaggtcactttagtcaccatcttggttttgacaggttttggttggcttctttactgcatcctgttttatcagcaaggtcttcgtgacctgtattttgtgccaacctcctatttcatcctgtgactaagaatccctaacctcctgggaatgcagcctagcacgtctcagcctcgttttaccccactcctattcctggtagagttgctctagtttgaatgcctctgatagtaccagtgccccatctgtcggtgaagtgacagggatcactgaaggtccacaagagaatttctcagctgcagcacctgattaaagccttcttccctggcaacattcatctcagtgactggcattctgtgtggcaagcaacaggatctagaccacactcttagtgttttggtgacaagagttcatcacgctactcagaactgcatgtaatttaaaatgtatgcattgttcattcctggaatttttcatttactgttttctgactatgattgactgtgggtaactgaaaccatagaaagagaaaccacagataaaggcagactaccatagtcagaggttgtcagaatgttaatcttaaataatgagattcagaaaagatgattaagtatagagtttatttgagcacaaagcttgggaatggccacccacaaaagcactgactccagacaaatagggtcagcatttgataagtggggaagctaaagtttcaattatataggcaaagacagagaaattctagcaggattacaacattttccatataagatcaggtatacatgccatagcaatttgattgtttacagattgccacattccaatagagattactttattactctttgaggaggggcagtaatctgagggtgtcttatttccagcactgcttggtctttttaattatttacagaaacaaaaggaagaatttgcagctggatgtcatgtgactcaggttttataggcacattcaagactcagtataatttaaagtcccaacagctttaagtttgaactatttaatttcacagcctaaaatatttcctgtcttagaaataaacatttcataagttttaaattgcatgctgttctgaaatcttgttacaaaacaccagagatttgttctaggtcctgttgctcaccacacagaaaaccagccactgaaatgagtgtcgtcaggaaagaaggctttaatcgggtgctgcagccaagaagagtgggaatgagtctcacatccatctctctgatgactaaaattgggaggtttgtatagtggagaaggagggaaaacaggaattagggaggagtaaggaagcagttatgatggattaagggtctgatgactcactgcctagatgcagtgatctgatgagtttcagttcatctcctgaggaaggaactcagatgagacaaatgtaagtttgaagtgttaagaccaaggagaatcagcttctatgtttattcaaaaaactgtaaatattagttccatgagacaattgaggcagtttcaatcttcactttctatgtatcaattcctcagtcatggggaatctgctggtcatttcttttggctgcttcctgcggaagagggggcattgtgggatgatcatgaggaatgaaaacattacccctgtaaatggaagtactcatgagtacctggctggcatccagcttgttgaaacaccatgtgactccaattgtgtcttgttataataaaagaaaacagattcttactgaaattagggaaatagctatattgccacagattaagaatattcagaaatagtttctgaattctggagaattcaagtagagatagagaaatatgcatcaggttttgtttacaaggctaaaatagcttaaaaaaagaatttttcttgactctgaaaaacaaaacaaaaagaattagcaatgtttgaaagaaaaaagccacaaaaattatttcagttctctaatagttcagtgcatgcaattgactcttgtatttgcttcatattgggttaacaatcttcatgaacaaaaacagctctgtaattttagtcctggccatttctttttttagtccaatggcataatcaccaaagttatcagaaatctatattcaagagtctttttcatggaatctcctaaagaagtaagttgttttttaaaaaaacaaaaacaggccgggtgcagtggctcacgtctgtaatcccagcactttgggaggccgaggcgggtggatcacctgaggtcaggatttcgagaccagcctggccaacatggtgaaaccccgtctccactaaaaatacaaaaattagctgagcatggtggcaggcatctgttaacccagctacctgggaggctgaggcaggagagagaatcacttgaacccggggggtagaggttgcagtgagctgagattgtgccactgcaatccagcctgggcaacagagcgagactccatctcaaaacaaaatcaaaaacaaaaaaccaagacatttattctctcatggtttttgaggctagaagtccagaatcaaagcattagctgagctggtcctttttgcaggttctgatagagaattctgtgcctttcacaccactttcagtggttgctggcaatgcttggcgtggctcggcttgtagctgtatcactgcaatttcctccctcagctgcccatggcattccactctctgcatctctgcatgtccttcttcttctcataaggggtcagttatcagatttagggcccacctaaaatgatcctatttccaaataaggtcacatcttgacgttttggatggacacaaattttggagggacactattcaacccattacaatagtcatccaggaactatcaatgaccctactataattaaactaccaatgtttacacattcttcttttgtccgtagagatacagtgactatagcaaattctttggtaatttcctaatccagaaatggtgtggatattcagaaatctagatcagctttactctgtatatgtgtaagaaaatttctaagactaagaagtaagttttggactgtagctgattataagctgctttttgagaagaatcaaaatgaagcaataattgtggatgacaaaagtcttaggacagccatagttaaaaacacagttgacaaagaaatttggttatttctgtgtcatacaacaatttaacatagtaatcattattactatcactgataacatatactaagacatataagaattttaggaatctcatacaactttggaacacattaataacatatttatataaatataacccaaagaaagttaaatacaacttcatatttgataatgttttctgtataattttgacatatcaaataagcttacatgtctctcttggactttgggggaacttaatatctcaaaagttagtttgaggtaaaaaaaaaaaaaactgaattagaacttgagatttttgctttgcaagtttgtcaaatatcaaagatctaaagcacttgatattcccaaataggatcacaggtcattcatctagccaaaatgacaattcaaagatttcaaaaaaatgataacatttattctttgatagagaggagactcagtttcccaaacaataaaacctaataaaggcagcatgaagccaactaaatctttctctttctttctttctcttttttctgcagtttactcaaaaggtagacaacaatcttttattatctcttattaatattacatgaaaattttgttcaaaagataaaaccaaattctaacatttgtatagtgtactattaatgttaaagctaattttaatggaaccttatgaatgtatctatttaattttaatcagtttgaccaaaagataatatttccataaatcctttataaccttttacaattttctactaaaatgtagatcagtgctccaagaaaacctcgttattctgacacagggtcccagatgctggccttgcattggtgtgcttttgatattaatgtttaatttgtagaaaaattctgaactaatcttatctctcaaaatcggcccttaaaatctcatgcactcacctcttccttgatagtccctaggcctggaaggattgaatagttttaatatatagctctgtgtctcatgaaagcaactcattttgattgttgccttctcccaggtctgaagacaaggctttgactggtgtcaatgtttaagatttagcaggagtcggtgcctttttcagacccaggagttaaaggcctgtaacttgacagccaaggactttaaaagcaatacagaaagttacacggatgtaaaaaccttaatttatttatattttaattttatttattttattgagacaggcttttgctctgttccccaggtcagagtgcagtggtgcaatcatggcctgctgtaagcctccacctcctgagctcaagcaatcctcccatctcagcctcccaaataactaggactacaggaaagtgccacacaccttgctatttttttttttttttttggtagagatgggacctccctacgttgcctaggctggtcttaaactcctgggctcaagtgatcctcccatctctgtttcccaaagtgttggggttacaggcatgagccaccatgcctggcccttcattccttttaattccagttttcttaagccatcaaaaacctaataacaatgacataggaattatctcaataaaacatagaatctgtttcttaggccagttaccaaaaagcaaagaaagatcatatgtagtatggttgtctctcctatggtatcttaactttttcatattcctctcccctgcttactgtttcctttcttctttattttataaatcaccttttcaagtccataatgtgaatcaacctttagataacttttgaatttagagaatttttttctcagtagggatacattttctttgtcacattttatatacagaattatatattaattagaattcttattctttagcaaccttacattttaatgaaaaacctaggaagcaagaaatattgaactatctatcagatatcagcatcttttagataagaacattccataatttttaaaaacatgtttccccattttataatcccttcttaattagaaattaccaagacatttaatgaccattcaaatgatttcaagattttaaattacacaaaaatttcacccacagtatttaccccatttatattttattcacttttagcaatttatctagattacttaggagaactgagatattagacaaaactagtcattatttctttgtcaactaatttttataacctgtgcatattaggtgttcacctaagtaagaagcttaaggttaaatacctgggtattttcatcaataactcagaagattcagctgttttcataaaaccaaaaacatgaaattagtcttatttatcaaaaaaatcactcaaagatcattttgtttttggttgggtttatagtcttataatcttttgtgccaaaccctgacatctttaaatatgtagcacaggcaaatataaaacctggaccaaaaatgtatgctgaatattccaaagacatttctatttttattttacccataatcttaaagccagcttgtttattaaatatttactaaagtcatgtgaacttgaaaaatgcttagacttattaacttatgggtgctcttttgtttacaagccaatttggtactctgtagacacaatatataataaatgtacattcacataaacacatctagacatatatgcacacacacacaaaaagatccaatagcttttaccttgaaactctagccatgagataaaaacataaatttatcagtttacaaacatgttcacatggctaaactttgtttacctcaatagataatccaatgagggctgtgaccaaaattttgggtaaagcaatggtagtttaattctaaaggacaaacctcccaaaactccaaagaacactgggggccaagcatactacagaagaatgtcacatactaactgtgcccgactagggttagaacagaagcataaaagcctgcatacatggagctccatcctattttcccattcaacagcaaaatgaatccatttgtaagacagtactacaattgaaagactcatggagtccaagcctccccaaactccaaagaatgttgggacaaatagcattacaaaagaatagtatttttctttgttcttttcgtttataactatatgcagaccaattttgaagaacacacccaagtcaactgcattctagaatcaaattccaatttcccatgactatatcaacacacagaaaaaaaataatcaaaaatacagtctaactgcagtagtgactaacaagccccaacagtatctgaactgtagttgaggtgcttcccttttatagttggttgggcttgttcaacctgcaaacagaaattccttcaaaattccccatatcaagaggaactgatcctgctctctgatatccacaaaagatgctcatttatctggttacacacacaattactaacaagcccccaggagtgtccagaccgaaatggtcagagtgcttccctttttcaattggttgggcttgttcaacctgcaaacaaaaattcctttaaaatttcccaaattgagaagagcagattccactgactgggcccacacaagacactcactgatgtggaggcagatgtcatatttcaaaggctgtcttcctaggcaatcaggaatacagttggggctggcaacagtgcgagcagagagagagacacaaaaatctacctctggctaaaaagagacagatggctagctgcttaggagggcttctgagactctcctgtccctcgacagccaagtcacgagcaatgcactcctgatcagggaaccaagatctgttagcaaaatgccaggggtttggtctaggtcctgcagctcactgcacagaaagccaatcgctgagacaacaagtattgccagggaagaaggctttaatcagatgctgcagctgaggagaacagaaaataagtctcaaatccatctctccaactgactaaaattgggggatttctcttcaaggaacccttattttacttaatagtggccccaaagcacaaaagtagtgatgttggcatactgttatgattgttctattttattattagttattatggttagtctcttactgtgcctaaattataaattaaacttcatcatagatatataatagtatatataaagagtttggttgtggtttcaggtatccactgggggccttagaatgtaccccccttggatactggaggactaaagtagatgttttctaaagtttctcacagatccaacattccaaagttcttcatttccagcaaattcagctcagagagttagagtcaaactttatttgaagactttagtaattcaatgtcaattggaagtgatttacaaaatggaacaaacactaactttgtaaaacatagaaaaaatatttttaaagcatagtacataacaaaatacctttcttggaggtattataaaaaattccctggaatggaaaatatattttgaggaaaatcttgaaaattgcaaagcatttttaaagagagttaaaccctgggctaaagttgtggcagacacccatgccccatcccaccatcctggccaggtgccacttccatgtgctgtcctctaggaataggggctggctgagttcaggaaagcagcattagggttgtaggagtgattcagtttttcactgctaagaggtgaaaaaaattttacttttaaaaagaaaatgtattatcagatctcaagtatgtttttttcccttaagaatgaaactttcactttgttgagtgtatttaattttatttattcattttccttcctgaaattttggactcctttattaggctgacaaagcccactgccattcatattcaacttacctgcataatggtctcatttgcaatttgtgggtacgctgaaggagcgttgctgggctgtccttctgactttcttctgctgtgaagaccatttgtgagtttccaggcaatgggcgggtgggagggaattctcccaactgtaaaacccaggctttcaaacacttgaatgccaacagttcaactcttttatcagagccttggcattattcctgaagctcctcacaataaacttctgtaccaaattaattaaagaaaagcctgataattccattccgaggcattccaatgaaagtaatttcagatacataatgcacaattagcttttccacttaacttccaaatgaaatgctcatggtatttagtaccatttgcattaatcagcacaaccatcaaatccttaggcagaagagagaaactgaaaatcttggggaagaagatcttcttgaagtgtggtggtcattagattatctgtgtgaagtgtggtggtcattaagctatctaaataaatggtagacaagtggctacagggctacctcctgcctttcataaagaaggagcaattttaggaaagaatatgatgggacctactgtagaagaaaaattattcactggacacttgttaaaacagtaagaaaaaaaaaaacagtaagaaagactttgttcaagactattataataccagtcaactctattgcaataggagagagagattgagctaaactcctaatacagcagacagcttgggacttagggccaatgggcagaatgagaggtcagtggatggaaaattactaagaggtgacaccaagggtaggaagattcttgctaaaaacaggcagagaactcagatatcaaggatgggggcggggaggaactgatcagatatcaagggtgggagatgacttagaaggattcttgctaacatggagctcaccaagggcacacagaaaaccaaggtgaggcctggtagagaaaagggctcaggggagtctaactaaagtttggttaaggagggccgtctttgtcactgatcttcagctattttgtgataaaatagtagaacgtgggctcatgaggaaatcacagggttaaacattaggcactgggcagaattcagtgaagatggttatctgtgggagaaagggaactaatgaagaccacagaggctttacctcctgggcaacccttcaaagtccagagtcattggtgtattacctgtgagttggtgtggccctgcctaagaacatgtacaatctcagcatcgcaacaaggctcctgtgggagccccgggtgagttattgctggtgttgcctgccagaagctgcacctccagttagttgctcatcacaaggggaggctggctgaggtgccattggctcccaccccagcagcaggcatagaaaaactcccaggtgaggtgagggcccatcctgacccaaggttttcctattgccaacattacacagcagtgctcctgcatggctggccccgtcctacctctttagtttccacaaatcttttacatccggtttctctatcatctatccaactactagttcttccttctgggatctggtgtgtccagtatgctgttgctggtcaagtcagtattgaattgataatacatttatgtagcctgaagcccataaactctaaaaatacaatatgttcacttgcacaagcccacaaaagatcttatgccctgttcctacaatctcttcatcaataaggtgcatgaagggcatgccaaaattaaatcctggcatggagagatgctacagaagacaggccatgtagagacaactggaagcaaagtgaatgtcacttttttttttttttttttttaaacagagtctccctctgtcgccaggctggagtacagtggcatgatctcggctcactgcaacctccacctcctgggttcaagtgattctcctgcctcagcctcccgagtagctgggactacaggcgcacaccaccatgcccagctaatttttttttttttttttttttttttttttgagacagagtctcgctctgtcgcccaggctggagtgcagtggcgggatgtcggctcactgcaagctccgcctcccgggttcacgccattctcctgcctcagcctcccaagtagctgggactacaggcgcccgccactacgcccggctaattttttgtatttttagtagagacggggtttcaccatgttggccagaatggtctcgatctcttgacctcgtgatccgcccgcctcggcctcacaaagtttaactaggttctcagtaacctgagactgagagctagttgtgagatcggtgactctactgtcatgtgatggtgttgtgatgtattatccatatgttaaggatcatattaaacacacacatttacagtggacctactgtcagttcatatttaacttacctgcatcatggtctcatttacaattggtggacaccctgaagaaggcttgcagctgaagtagctgccaggcaggttttacttaattcttgtttattcacaaggaactgaggctctgacaggctgagaggtctgcctaaggttgtaggggaaaaaagtgacagggctggaagtcgagcctcaccgttgtgattccaagaccagactctttcctacatgtcgatagtcatctgtacacaccatcagtgctggtcagtgcgcctcactcacccactaaagactggccatctaacttccgaattcaagggtacctcccttatcttgcagccatctgttgcctgccgcagcagcagggaggaattaagagcagcagctgcagctccagcagctcaggggcagctctgggctccctaaatccaccagtggagacccacgtgcagttgtggggaaaagtttaactgccttgatcgttttccttccagtatgttctgcctttagcttgcctacctggtcctgtctgctggcttggcattgactttcagagagatatgctccagactacacaagtggttttaagctcctggctgtgttgatcactgttctttcccctgggcctccagtttttctgtgcctgtcctgcatctctgaaatcaagtgatatttattcatagctctctaaacctctggcttgggtttcttctggtaaagacgaactcttctttctgctgaggaactatgcaacactctggccttctctctacttcctctttcatccctaaacctttcaggaagtgaaagataggtcttgtttagaaaaaatgtggaagctgcttcagcacaggtctgtggccactctagtctgtttggcttcctctgttttctgcagccttgacttgatgccacttgtgcacccggcagcatgggcatcggcatctattgtgctggcaagggtggaggagaaacagctttgctgttagtcctggcctgagcattgctcatagtgccgactttaattaccaaacctttatcaatggatcccacaaaaggctttggttcattccattttgctttcccctaatttacttttgagaatgctggctgaaagctttagtcattcacaaagttggcttctgacctagaaatctctcactttctttggcctgagtgcttggcatctctactccctccagctaccacattcttcagctcctttggaaagatcagtattattcacagtggtaatcaaagaggcatcatttacagtcttatctcatctctcaacttctccatcatgattggaaaattgattccctactgaatcaatcaatatggcacagccatatttcttatgcaataatattaaactttccctattaacaattgattcatgtcccttgttgtgaatgtaacacaaagaaatgaagtatcctaataaatgaattggacctggctggctacagtgtagaaccacttgttggcgtcctcacaccagggcatgtgggaagaagtgcattggcacatctgtggccatacccattcctgagggaggtgaagagatggattgaggctggagatgcttgggaaaggtgttcataaaaaataccctcacttatcagcaaactcagagataaagaagaggcacaattcaaggctttcagatgtcaatttctttccaaactagagtaagaattcagcgtaagtaaatccatagggatagaaattggattagtggttgccagagagtggcaaaaggagagttgggattgactgctaataatttatttttggggtgatgagaatgtatgggaccagatacttgtgatggttacacaaccttgtaaatatgctaaaaaccactgcattgtacaccttagaaaatggtaaaaaaatgttttggccagcagggacctcacagctcctctggtcaggacatgtgccagactaaccaactgtcttcatttgtctgggactaaagaggttcctggggtctgagactgtcactgctgaaaccagtgacaaagcaggatgattcagtcaccctagtgtgtgctggggcactgttcaaggatgacagcgaaggcaggcaacctcccatttaacagggctatttctcattcacaatgctcttactaccaccttgtgaagtagctgccagggcaggttttacttaattcttgtttattcacaaggaactgaggctctaacaggctgagaggtctgcctaaggttgtaggggaaataagtgacagggctggaagtcgagcctcacccttgtgattccaagtccagactctttcctgcatgcgtatagtcatttttacacaccatcagtctggtcagtgtgcctcactcacccactaaaggccggtcatctaacttccaattcaagagtacctctttcatctttccttcccacccctagaagctgcctcctgtgaaacctctcctaacacagtgatccacccagcaccatctctaagttcatcttccttgtccctctgccatctctgtaggcagggactgtgtctcagtcatctctgctcttggttcctattaccttgcctggtgctcgataagccccagctgaaggaagcctggtgtctgttccaaagaacaaacaggaacagaggtctcagataagagaatatcctgttgtccatctctttgctattcctttcttaaggccgaatgagtctcttttcctgatgtgttcatatttcttaggtgtcattttctgaggagcttgcgggtggagctgtcacaatctgtctcttttcctgggttctgaagtgctgcttttcaaaatgtgttgtaaacatgctccaaaggccaagccaagccaatgggcaacaggcaatgagtggtacagctcatgcagtgaggcctgtggcctgggggaaaggatgtgccaggaggcaggcaggcttcctggcaggaaggcagttctggaaagtcttaatatcagggaagactgtcatcaatcttgaccataggttgcatgccagtatggggataggtgggtaaagcgagggtgctactgccagaagtaaggcagggttccagatccagagagatggagtgctggaatactctaggcacaaggtttcagaactgagttaaaggtaaaaagattggggcaacataggcaatgtgacgtcaaatccaagggtatggaattagaagacccagacgatggggctccaatgaccaagggatgctagttggggaggcaggtgggcagaaactgtgaccaagaagaacttggcacagatgatccatttaaatgagagggtggagctgtccttgcaaaccaatgatgcagctgatgccatgcagtggatcttccttccccctaaacagagagtataagtatgagtttgagaaatgtgctataagcacacagaaactcatgcacacacgcagggaggagatttgcctttaatttgttttgcttgcacctgttgactcatgggggtcaatggtatcctgtaaacataccagataccaaatgaaagttccctcagataacctcagataagacagccagttctcccatggcttattgttattattattagaattatatttatactgtcttttttgtctctatttttttatttttaaattttttatttccataggtttttggggaacaagtggtatttgattacatgagtaagttctttagtggtgatttgtgagattttggtgcacccatcaccatggtagtatacactgaacccaatttgtagtcttttatctctcaccccaccgaccctttcccccaagtccccaaagtccattgtatcattgttatgcctttgcatcctcatagtttagctcccacttatgagtgagaacacacaatgtttggttttccattcctaagttacttcatttagaataatagtctccaattccatctaggttgctgcaaatgccattaatttattcctttttatggcctagtagtattccattgtgtatgtgtgtgtgtgtgtgtacacatcataccacatttcctttattcacttgttgattaatgggcatttgggctgcttccatatttttgcatttacaaattgtgctgctataaacatgcatgtttgagaatctttttcgtataatgacttcttttcctctgggtagatacacagtagtgggattgctggatcaaatggtagttctacttttagttctttaaaaaaactccacactgttttccatagttgttatactagtttacattcccatcagcagtgtagaagtgttcccttttcaccacatctataccagcatgtactattttttttttatgccattcttgcaggaatgaggtggtatcgtattgtggttttgatttgcattttcctgattattagtgatgttgagcattttttcatgtttcttggccatttttatctcttcttttgaaaattgtctattcatatccttagcccactttttgatgggattatttgttttttcttgctaatttgtttgagttccttgtacattctagatagtagccctctgttgaatgtatagattgtagaatgtatagattgtgaatattttctctcgttctttgggttgtctatttaccctcccgactgttccttttacagcgcagaagctctttagtttaattaagtcccactgatttatctttttatctttgtttttgttgcatttgcttttgggttcttggtcatgaagtctttgcctaagccaatgtctagaagggtctttccaatgttatcttctagaatttttagtttcaggtcttagatttaagtccttgaaccatcttgagttgatttttgtgtcaggtgagagatgaggatccagtttcattctcctacatgtggctagccaattatcacagcaccatttgttgaatagggtgtcctttcccccacttcatgcttttgtttgctttgtcaaggatcagttggctgtaagtatttgggtttatttctgggttccctattctgttccattggtctatgtgcctattcttataccatgctgttttggtgactatggccttatagtatactttcaaatcaggtaatgtgatatctccagatttgttctttttggttagtcttgctttggctatgcaggctcttttttggttccatatgaatcttagttgttttttctacttctttgaagaatgctggtggcattttgatgggaatgcattaatttgtagattgcttttggcagtatggtcattttcacagtattggttctacccatccatgagcatggtatgtgtttccatttgtttgttttgtctgtgatttctttcagcagtgttttgttgttttccttgtagaggtctttcatctccttgtctcggtatactcctaagtattttattttattttattttattttttgcacctattggaaaagggattgagttcttgatttgattctcgggttggtctctgttggtatatagcagagctgctgattcatgtacattaattttgtatcctgaaactttactgaattcatttaccagttcttggagctttctggaggtgtcattagggttttctaggtatacaatcatatcatcagcaaacagcaacagtttgacttcctctttactgatttggatgccctttatttctttctcttgtctgatcactctggctaggacttccagtactatgttgaatagaagtggtgagtgtgggcatccttgtcttgttccagttctcagagggaatgctttcaactttttgccattcagtattatgttggctgtgggtttgtcatagatggcttgaagtatgttattacactgaagtatgtcccttctatgccgattttcctgagggctttaatcatgctcccatggcttactaagtgatgactgtctttagattaggttgtgggtttttgtttttttaaaacattttgactagttcaaaaagcactgggtggttattctaccccaatatgcacctattaagagagaaaggtgagaggaaaaaaaaaatgaaagtcccactctacatgatactgattgttacccatgttttatcctttctagtaaaccccttgatcacaaagttgttcaaaatgccctatttccagcctttggcaccaacctgcaattgcagtgttgcttttgaccttcatcctaacatccaccctcattagtgccatttttctctggtagagtcatgatttaacactcattacttccaacacaaagttctgctttgccaaatcagatcacaatacagaagtagcacatgcatactttcctctaatttaaaaggtgtataaggaaaactagtatttagccttaggcttgggactcctcagcacctgtgaaatgttggggctggtgtttacatttcctgagggtccaaaggtttcaggtaaggcagagccagcaaacttgtggcctgcaggctgcttccaagctattgaactgtcttgttggcagaacatgaaaaacttggaggccaggtgcagtggggctcatgcctgtaatcccagtactttgggaggccgagggaggcagatcacctgagggcaggagttcgagaccggcctgcccaacatggtgaaaccccatctctactaaaaaaattagctgagcgcagtgatgggtgcttgtaatcccagctactcgggaagctgaggcaggagaatcacttgaacctgggaggcggaggttgcagtgagccaagatcacgtcactgcactcaagcctaggcgacagagcaagactccatctcaaaaaaaagaaaagaaagacggagagttccagctccctctgaaacaattgtgagatttggctgcagtcagctggacttgagtgctggatgctccttttggacagatataggttctctgcagtccccacccctccctattgttttttgccagctacatcctttggtgatgctcacctgcctgggccctggaggcatgtcagtttgtaagttcatgaaattagcacttagctgaaactacttgactgtagcggacaaatcattccatcatcccccactcctcatttgaaatctcaaaacaagggtggaccataactctcttctccgagcctttctcacctctcttctagttcatctgtattccccagatcctttctcctgtgaccaataaatcccatctttaggctttggccttctgcttttctctctggaccttctccctgagatgcttcttgcattcctgtggtcccccaattgactgttggctgatgacccccacaaagctcttggtaccctcatctttcccctcaaggtctcatgctaggattaaactcagagagcaatggagacttgactttactgtggggcagctctgaatcaaatcctgggttggcagggtggctgtgggcacacatggaacatccctgggccttcacacctgtgtgatggttgtagcattacttatggtgattgaggatatttaaggtcatttgtagtgggtgcttggcaatggcagctgcttcctaagcccaaggtcactgggtgtcaaagccttgtagtttccacactattgtactgcctcaatcccagaagccttgtcttcaaacatgactttttacaatgagttgtcagtgttgtctcccttgcagtgcccaggacgaggcctgccagggagttggcaatggatggatgcacaggcaggccaccctgacaaacgggacaaggtagaatctgctgacaaggcagattgtcacggagttttttaggagtctggaagtgacaagaatggggcatgtgcctggtggcactctgcaatcctgtcacatcaaattggagctgttatttctatcattagcagcaaaggaagcaactcaactctctggagcttccttattaacaatcacaaccagcaactaaacaaaggcaggaaagcagagtgtcaatggtgatcggaggtttcctccacagcttccacaagcaccattttctccttaataatgggttacattttcaggagaggcttactttttgttttgttatactcttgtactttaaaagaaaaaaaaagaaaagaaaatgcagatatttcacagaactggggaaggttagggaggggaagggagaggaaaggaagtaagatttggtccacttctaacactgggcttggtgcattgcattaattatttcactttccatgatccagacttaactttttaagatcctaggctaggtttaagtgtagaaatatgaagtcatagaatgtaatacctggctgggtgtggtggctcacatctgtgatcccagcactttgagagactgaggcgggtggatcacttgaggtcaggagtcggacaccagcctggtcaacatggtaaaaccccatctctactaaaaacacaaacaaattagcgaggtgtggtggcacatgcctgtaatcccagctacccaggaggctgatgcaggagaatcacattaacccaggaggaggaggctacaattagctgagaatgcaccactgcattccagcctggggagacacagtgagacttcctctaaaaaaaaaaaaaaaagaatgcaatcctctttccattctacaactgagaaagaagtcacgtggtggctagtgataaaaagaacaggtggcagttctccttacccctcatgtctccatgtgtctgagatccagggacatttaaaatactgctgaaaggtcaggggacattggtgaaaacaactatgcaagcaaagaatgtttttcttcctgtgcagagaaagaaaatcccactttctctgtgtgtaagccatggtatgtgggctccctgagcccagtgaaatatgcagagatggtaaaactgtattaaaatctgattttctttttgttaaaaagatacccaggaagaaactatttcttttcttcttattattggatattgtcttttctaggctaggtacctggaagtgagacagctgtctctattaggagtgctaagctggcaccctgggatggcagaagaaaagagggaaggaactaaggtttcgaagatgaatattgggagtgacatgaaagagtcttggaagcgagacgcttccagccttctttttatgtgcaacattaagttttccttatttttttaaaggaagtgcagtcagcattttatattctgccaatgaagccatcccaaggagattctttgagattctgacacatcatctgttaaagggaaataaacagtggagagctggagccggctcataccagccaattgctagaatctcctcttaactcttcattcagtggcatcacataggaagctccagtgaagtcatgtggatgtggaaattcactgtggtgggaatatttagatgacaaaaatcagcaacgctacaaattggggcttttttaggagtcagtttaccagcacaccgctggaaaatcgtgcagaaccattgaaagcattagagatatgtctaaggcctctgttaatgggcttgctatagcaaatagaatttactgcattccccccttgctcctgagaacctcccccactgtaccaccatacctcctatagcttctgaatacccccattacaccccactgctcctgaacaatcccattgtactccccactgctccagagacccccattggatccctggctcctgatcaccttccactgtgtcccccctctgctcctgatcacatcccactgtgctcccctctgctcctgatcaccttccactgtgtcccacctctgccccaatcacctcccactgtgtcccacctcatgctcctgatcacctcccactgtacttccagctgctcctaaacaacccccagagtacttcccacttctcctgagcaccctccactgcaaccccatactattactgaacacccccactgccataaccaccactgttcctgaacacccccactgctcccgaacacctccactgtaccctgactactcctgaaaacacttcagtgtatctcctactcctcctgaacacccccactgtacttcccactgctcctgaacaccccactgtacttcccactgctcctgaacaccctactgtacttcccactgctcctgaacaccccactgtacttcccactgctcctgaacaaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacacccccactgtacttcccactgctcctgaacaaccccactgtacttcccactgctcctgaacacccccactgtacttcccactgctcctgaacaccccactgtacttcccactgctcctgaacacccccactgtacttcccactgctcctgaacaacccactgtacttcccactgctcctgaacaccccactgtacttcccactgctcctgaacacccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacacccctgctatatcccccactgttcctgaacaccccccatttctcttgaactcacccctccctcactgcttctgaacacggccactgtaccctgcactgctcttgaacactctccattgtaccctgactactcctaaaaacacctcactgtaccctttactgctcctgaacatcctcctactatttcccccactgctcctgagcacccccgctgtatactcactgctcctgagcaccccactggatcagtcactgttcctgaacacccccactgtaccccctactgtttctggtcaccccttcactgcacccccactgcttctgaacactccccactatatactcactgctcctcaacatttctactcttcccccgactgttcctgaaaacctctaactgtaccacctgctgcttctgaacacctcaactgtaccctctactgctcacgaacacccccacactatatcccccattgctcctgaacaccctcactgtacctctcagtgctccggaatatcccccactgtaaccactatccccaaatatccccccactgctcctgaacaccattcgccctacccccaactgcttctgaacaccccacactgtaatcaccattgttcctgaatattgcctcactactcctaaacaggcctactgtaccatccgctgctcttgaacacccctcactctatccccgactactcctgaacatcccctctgctcctgaacacctacccactatatcattaagtgctcctgaacaccccagtactcctgaacactccactgctcctgaacactccctctgtacccgtagtgctcctgaacacttcccactgtacccactagtgctcctgaacatcccccactactcctgaacagccccactatacctcctgctgctcctagacacccccactgtaccccctgctcctgaacaccccactgtactccttactgcccttgaacacactcactattcctgaacaccccccactgtacccctcactacttttttttttttttttttttggtgacagagtttcactctattgcccaggctggagtacagtggcatgatcttagctctccgcaacccccacttcccggattcaagtgattttcctgcctaagcctcctgagtagctgggattacaggtgcacgccaccacccctggctaaattttgtatttttagtagaggcaggatttcaccatattggttaggctgatctcgaactcctcaccctgtgatccacccacctcggcctcccaaagtgttgagattacaggcgtgagtcacacccctcattactcttgagtaccccccactatatgccccatctatatcactgttgaacatccccatctatatcactcatgtacttctgtacacccctcactgtaccactcattgcttctgaggcccctcccccatcataatctccccctggcagtcagtgcagttaccattgctatgcatggctgtcactgctaatcattgatatgtgcttttgtatatctgtcactcatttatggtttagagtccctgtagaagccttcagttggctaagctgaagtcatatgtgcacaccctcaatgccagaaggtaggaagagagaagatctgtgtgttgtgactagctgtgcctctcccaccaccaagactccatggtggagtccaggaactaggaaggagattcacatgctgcgtagaagagaaagaacctggtaaacactcagtgtttctgcataaagtgaatcatattattgctctttggatatatgttttctgttgggtgatgtttgaggtggtctcaggtcatttttctcatgtacctctgtggatagttagtgatggcccagtccaaaatgtacacatatttttctcaaagaggagagcaaagtctatatagtcgttccttggtatctgtgggagattggtttcaggacctccttcagacaccaagatctgaggatgctcaagtccctcatataaaatggtgtaatatttgtctctaacctaagcacatcattctgtatactttaaatcagtgatccccaatttttttgacaccagggactgggttcatgaaagacaatgtttccatgcaccggggtggggagatggttttgaaatgattcaagtgtattacatttacagtgcacttattttctattattattacattgtaatatataaggaaataattatacaactcatcctaaagtagaatcagtaggagctctgagcttgttttccagcaactagatgttctgttccatctgggggtgatgggagacagtgacagaccatcaggcattagattctcataaggagcacacaacctggatccctcacatgagcagttcacaatagagttcatgctcctatgagaatctaacgctgctgctgatctgacaggaggcagagctcaggcagtaatgtgggtgaaggggggcagctgtaaatgcagatgaagcttccctttcttgcttgcttgccctcggctcgccttctgctgtgcagcccagttcctaacaggccacagaccagtccctggctgtggccttggggctggggacccctgctttaaaccatttctagattacttctaatgactaaaacaatgtaaatgctatgtaaatagttcttatactgtatttttaaagtctgtatttttttattgttgtattgttagtttttcgtttttatttttttgagtatttttggtctgcttcattgaacccacagatgtggaacccatggatatggagggccggccacattcctttttattaaggtatattacagaatgtatacacaagtttccttggttccaagaaacagactgattctagccaactgagagaaaaaggacttatggctaggaaacacttgagctgctcctggatctggaaagctagtcaagaaacagggtggctttcgcaatggtttctgtctttcaggatggatttggtctttttctcgtggctcacatgggctctgtaacttggcatcactacttctctcctgctttggctgatttcctgctccggcaacctggcttggattttgatttggttcattactaatcgtttgttgggtagaaagcctcaaggatctttggctaggctaaggaatgagccttgtgcacacacagtttattcaatgaccacctacccatgcccaaagaatcacatagagctgttttcctgaacaccttgattagaaagggcttttgggtgtggcagacaccatgtctcatctgtgtctgctttgaggtcccctaattgtgacccaactcctctccctgtccttgggaagtcattgtcactttttggaaaataaagaaaccattatttagtaaggattatgcattgcatctgctattatgcattatataccttatctcaaagaatcctcacctcctctctctgaggtaggcattactcctagtttacatacgaggaaattgaggatcaccgaggttatgaccctgaggtaaggtggcggagctggatttcaaaatatatatatatatatatatatatattttttttttttttttttttttttttttttttggagacagagtcttgctttctcacgcaggctggagtgcagtggtatggtcttggctcactgcaacctctgcctcccaggttcaagcaattctcctgcctcagcctcccaaatagctgggaatacaggcacatgccaccgtgcctggctaatttttgtatttttaatagagatgaggtttcaccatattgaccaggctgatctggaactcctgacctcaagtgctttgcctgcctcaaagataataaataatttgtctggtctttgtcctgggttcttggcatggagcttctaaaacccatggagtttcctgggtgatagcagtgggtttgttatggtaatgaggtgactcctggtaggcccatacatagcttcaaggtaggggctggtcaccagaaagaccagccacaaggtaggattttgagccagcctgacctccaggaaggggcgtggtggctggagattcagttcaatcatgtgcctagtggtttaatcaatcatacctatacaaggaaaccttagtaaaaactagacaccaaactcagtggagcttcaccagttggtgaacacattattgtgctggaaggatgatgtgtcctgattctacagggaaaggtcacgtaagttttgtgtttaggaccctcccagacctcatcctatgcatcttttcatttgtctcttcctgatatgtatgcttaataaaattgtaatcataagtatagcacttttctaggtctgtgagtcattttaacaaatgattgaacctgagggcattgtggaacttcgaaatttgtagccagtcaatcagaagtgtggataacctggggacccctgaacttgctgcttgtgtctgaaatcaggacagtcttagagaggactgaaccccttaccttgtggaacctgtactaattccaggtggttcatgctgaaatagaggtgtaatacactcagctgatgtcaaaatagtgaggttttcttcattatcctttgcaatatttatctgactctttcattccagttttttccaccttttttttctgggatgtctttattaattatttcttcaaatattagctgccttctgttttccctctccttctgaaatttttattttaggcactgggtgccatgcatgaagtttgttgggggagtgtctttggaacaacacttggtaaggaatgaagaaagaattaggcaggggcagtggcagaatttgccacatcacagccaaggtctgtcgatctcactgggagtagggatggcctctttgaattgttctcagttaaggctctaccagtcattggatccaggctgccctcaggagggtgtctgattttggatgaagcagctctcttcatctaaactggagagggactcaactgagagttggcagtcaccagtcctcccattgagggagtattgaggaaatgagcacttcattacttaaggggaagaatctgggtcggagttggctaacaacagcccatgtgccaaacccagcccacagcctgtttttgttaaaaaaattaaataaataaataaataaataaaagcttacttggcgtgtctgtcttcacatagcctttcctctgttcatgtttgtctttaacgtctcccctcttcttataaaggcaccagttgtattggattagaacccatcctaatgatttcatcttgattatatttgcagagtccctatttccaaataaggtcatatttacaggtaccgggggttaggacttcaacttatattttgggggagggaaccacaattaaatccatgggagccagaaaatgttttcatttgccatttaaggaaacttctgtaaggaaaaaccccatatccctgttgcaggtgtgatggtgaagcaggtgtgagagctgagcaggcaggagttgcacaagtgattcccttgtctattacttgagtggccagacaccaggaggcagcaagtagatttctccaccgcctctgactactgaagccctgggagttgcttaagcttatctactaaccaccttgacaggcttgtaaaaattttgcaacatcattcttaaaaaagaaagaaaatccagcagccagcaaactgtccataacagagccaaatgactcactgccagcactgctctacatgttttaggaagtccttatcatctttccaccaacacatccaattattttctaaagcagctttattcccagaggatgcgtttattttttggtgtaatggcatctatcccaaaagttaacccctgatggttaccaagtgagaggtatctccagaggcataatggtcagtgtttaaaaaccagcactccaaaaagaaaagctggggtgggggggatgtgctgatatagtctttgccaatttccatggtgtaaacactcccacaatgattaatttcaaactactaatgtgaagtactgaacacagaattgagaagagatatgtacagttagctttcatgagctgatatgaagcaacttcagcacatcactgaatatctcaatatagagagaaaggagtatgatttgagatgtacagggaagacattctggaggaagtaggatttgaaatggactttgaagggtggctatcatttggtggtatctctagcattacacagccagccacatcagtttggcaatttgcttctgtcctactaagactaaactatgagattcctgagggcagagaacgtgttttattcatcatagtaaccctacagtaggtgtttcacaagtatttgttgaatgcaggaatggaaaatgaataaatagagagggcaaaggaattttaggcagaggggacattcacggtgtgggtaggacagagtgggaaggaataaatgaacaggaggttttgggttcagtgagtggtccatacttggagtatagtgttgggacatgtggtatttcagttatttatggctgtgtaacaagccatcaaaaatttaatgccttaaaacattaacacatttgttttgctcataaatctggaatttaaacagggctcaacaggatcagctcattctggttcatatggcatcgactggggtggcctgaagactgaggctataatcatatgaaggcttgctcactcatgagctgggaagactcaaagagctagggatttgaatagctgaggcaccttgaatatctgactctatgagggctccctgcatggtgtctccagtatggcagcctcagggcaactgcagttttttgtaccagctcagggctcctgagatgtatatcctaaaaagagcaaaccaggaagaagctgtaccctttggctgacatacccttggaagttacacagcatcactacaccatagcccctactcagattcaaggagcggaaacccagaatccacttctcagtgagaagagtgtgaggaacattgtaataagaccatttgggatgaaacacattttttatatatgcgatatatacatatgctatatattttccatgtatagtgtgtgtgtgtgtaaatacattggagcggccaccattggaaaatataatctgccacacatagtagatggaaggttgaaaagttggatgaggccaaattggaaggggtcttgaatgtcttagtaaagagtttgctctaagacatggaaccaacccaaatgcccatcaatgatagactggataaagaaaatgtggcacgaatacaccatgggatactatgcagccataaaaaggaatgagatcatgtcctttgcagggacatggatgaagctggaagccatcattctcagcaaactaacacaggaacagaaaaccaaacaccacatgttctcactcctaaatgggagttgaaccgtgagaacacacgaacacaaggagggaaacatcactcactggggcctgttagggggtagggggcgtgagtggagggaacctagatgatgggtcaataggtgcagcaaaccaccacggtacacgtatatctatgtaacaaacctgcaccttctgcatatgtatctccgagcttaaagtaaaattttttttttaagaaaagggtttgctctatttttcctctagaagcaattggcatactagttgctgatcctcccccagggttccacatatgtaggttcatcatccccagcaggtctgcaagactaacaggtagcatcatcatgtctttttattttattttatattttattttatttgatgtggtctcactatgtgtcccagcctggtctcaaactcctgggtttaagtcatcctctcgcctcagcctcccaaagtgttgggattacaggtgtgacccactgcatccagcccttagagatcttttgaaaaaagaaacctccctctggctgggcacggtggctcatgcctgtaatcccagcactttggtaggccaaggtgggaggatcacgaggtcaagagattgaggccatcctggccaacatggtgaaaccccatctctactgaaaaaaatacaaaaattacctgggtgtggtggcatgcacctgtagtccccgctacttgggaggctgaggcaggagaatggcgtgaacctgggaggcggaggttacagtgagccgagatcacgcccctgcacaccagcctggtgacagagcaagactccatttccaaaaaaaagaaaaaaaaaaccttcctcaaatgtcagggctctgcatttgatagcacctcagtacttgaaatccaagtgtctatttgcccaagcaaataatgatggcaaatcagaccacactggacatgcttcttgcctgtctcccagctggcacaaacctgcatctcacttgggcaggtgataatggggtggcctgtgatgggctacactggtgacagcactgagtatcaaaattgtcagagcacatctagattgactctgggcttattgcccaacagctcaaagaagaggccaaatccaccgtgttgattcttgctgaacacgtcacacctaatgctgattccatctgccaagggatgctggatccagacagaatgcaatttgcattcacagaccccaaggtgctagtcacttccattcaaaattgtggcctttctctgcagggtctctatctagcctgtttgaagaattcgaggtgaggacacactaattggctttgactgtttttctgagacacagatggggagaagctgccactgagttttggatgagtgtccttcgtctctgtcctccattctttgatgacttctctccttgcaacagtgagaaatttgtttctggccataaggcagttgttgggaggaatcctgagacagtgtgctctttcccatatttgtcaaaccacagatgttccccaatggagagaagatggttgcaggaatacagggaagacattgtaattaatacacaatccttcctcttgctcccgacttgaaatggtctgcgttcaaaagtctggaactaagaacacacattttcccatagaataacagtgccaggccaggcccacaaatgcacatttcatctataatgtgagctgagagagaaaggcagacatcaaccagcagacaggttggctcagcctaagtgcttgatgcagctacctaagctggttctgccgttcacagtttttttccatttctgaaatttggagccccaccagagatttcttaaaagctgcaagctctaatggcaaaggcaatgagggtctgaacactggagtggctagtgctaagtatattcatttgtaggacaggatctgcttgcactttaaaaaataatgaactgtggcttcaggtagctgacttcaggaaattgatgtgtttttaatttgtttgtttgtttgttcggtttctcaatgcactagaaagttttcacaatgaaaccactgagatgggggggtgggagtggcagggatgatgctgctccttctgaggcctgtccaataagctgattaactccgtcggcacacgcccagtgctaacgcaattaagctcacgcttgcaatcccccttagagtggccatttcgttttgcgcttagaaaaagtatcataaggccacaaactatgtatttaagcaggcctcttgccacttgtttgccacagctctgcaaacaacctgaagcttatactgagtgaagataaagttggagaatacagagtccctgttgttcagtgaattctgtgttaagtgctctgtttggaaacagggaattttgctgaatgaaacatcttaactgtaagattccctgtgtgtcatacacccattctcattgtcagagatcaggaattttgtttctcttgtatctagcactttctacaattaacatacaaagatattaatttggcaatttccttccttccttgcttccttcctcccttcctcccttccttctttccttccttccttcttcctttctttttcttttctttctttctttctttctttctttctttctttctttctttctttctttctttcttttctttctttccttccttccttccttccttccttccttccttccttccttccttccttccttccttccttccttcttttctttcatgtgcacaacttaaagtttggatatatagatatatatatctatatatccacagtgagttgattactagtcaagcagattaacatacctatcaccctatgtggttgcctcattttttgtgggtggttaagagcacctaaaatctatcttagcaaattttcagcatataatacaatattgtcaactatagtcctcatgctgtacattagatccctagacctattcatccctatataactataactttgtatcatttgatctacttctccccatttactccccactggtaactactgttctactctctctatatttttgactttattttagattccacatatgagtgagatcatgaggtatttttctttctgtatccagcttattccacttagcatattatcatccagattcatccatgttgttgtcaatatcagtatctccttttttatgctgaataatattccattgtatatacaccacaatttgttttccagtcattcatcaactgacatgtaggttgtttccatgtcttggctcttgtgaataatgctgcagtgaacatgggagacagatgcctttacaaggtgctgatttcatttccttttggttcatacccagcataggggttgctggatcatatggtagttctatttttattttctgaggaactttcatagttttccataatggctgtaccagtttagactcccaccaacagtgtaggaggcttcccttttctccacatcctcaccaacaatttttatctttgtctttttgataaaagccattctaacaggtgtgaggtgatatttcatcgtggttttgatttgcatttccctgaagattaatggtattgaacaccttttcctatacctgttggccatttttacatcttctttggaaaaatgtttatacaagtcctttgtctattttaaattcaggttatctgtttgtttgtttgctgttgagttgtttaaattccttatatattttggatattaaccccttatcagatatatggtttacaaatattttctctcagtctgtaggatgccttttcattttattaattgttttgtttggtatgcagaaacttttgtttgatgagatccacttgttttcttttgcttttattgcctgagctttcagtgtgatatctaaaaacattcactgccgaggccaatatcaaggagcttttcactatattttcttctacaattttatggtttcaggtcttacgttcacgtcttttattcattttaggttgaattttgtgtgtagtgtaaaataagggtccagttttattcttttgcacgtagctatccacttttcccaatgccattgattgaaaagattgttctttccccattgtatatttttggtggccttgtctaaaattagttgaccatatatgcatgggtttatttctgggtgctctgttctggtccgttggtctacatgtcggtttttatgccagtaccatagtgctttgattactctaactttgtaatataatttgaaatcaggaagtgtgatgcctccagctttgtttttctttttcaagattgttttggctatttagggtgttctgtagttccacatgagttttagaattgtttttcatatttctgtgaaaaatgccactggaattttgatagagattatgttaaatctgtatattgctttgggtagcatggccattttaacaatattaattctttcaactcatgaatatgagatatctttccattaatttgtgtagttttctatttctttcaccaatgttttatggttttcatataaggttcggatcttttacttccttggttaaatttattcataagtactgtattcttttttaattaaaatttttaaacattttaaatgcaacacttcacaaatttgcatgtcatccttgcacagaggtcatgctaatcttctttgtatcttttcaattttagtatatgtgctgccaaagtgagcacagtattatattctttttgatgctactataaatgggattgttttcttgactggcaattgttgccatccaacaatttacatgcttctggcttgaattgcagataagctccttcagaggagtaagtgtcttactaccttataatctctacagtactttctagaaagaatatgcttatctggtatcagttgctttaaattcagtggaatacagtaagacagagcattcaaacaatactagctcaactctagtggtacctggaatgtttagaatgtgccttattttcaacagtatgaccacagcagctcatcgactgtgagcatgacatcaatgacaattaaagcttgcctagaactttgtgtgtgcctagcattgttttaagtgttttagctataagatgtcatctggtcctgcaaacaatcctttgagggaggggtcttgttacttatttttaagtttacagatgaggaacctaaagcatagagagattaagaaatgtgcccaaggttacatctctagggaggagcagactcaaacacaagcagtttagctccagaaaatgtgttctacttactgagttataatgctcttttttcaaagagctaacctacatataaggaaatactatataccaggcactttttaatgtaaactcgtttaatctcaccacaagcccaagagatgagtactactgttatctgtattttacagataaaaaaactaaggcacaaataagctaagtgagtggtagagccccatttcaaacccagaagatctgatttccaagtctgtcctctcaatcatcatgccacagcactctcagaagagtcagaggcaaatagaatgccaatcctgaattgatttatgtagatttacatagcaagagatggtggatcataggctactttataagaagaccctcccattttccatcaaggctgaacatcactatatttagggacagttgtgcctggggatatgcatggtttcttcccaaataggctgggaaaatagtgccaggtgagaaaaaaaaagagtttgtattttgcttggagtattaagataaggagaccaaggtccaggggtatttgttttttcataagggtaaagataagggagaagcaaggagagacgacaagttggccctgctgtttccctgtgctttgagcttgcaatgtgcagggcatgagattgggagcagcccaggtagaagatggttcctagcataagatggggggaaacggggatgaatacactggtgtttgtctttccctagactgaatggccactctgctcccagaggctaagaaatggaatgcctaataggtaccagggagactccctgctttgcagcttatagccaacttataggaaaaaaaaaggtatgtgctgagcagaaaccataatttatcagctgtgccttacctagccaatgggacactttcctttttttttgatcccttttattagatgaggaaagaaagggaaagcaacacataaaatgttgatttgaaaaagaacatgatttcttaagaagaaatctgaagcctctcagctagggctcacctaagaatcaaagtggcacagcattccatcagggcccaggaatgaccatcaacttattaaggttgtgaagctggaagttttcgtaaagacctgccatttgtcacaggacctccttcagccttttccttgatatccagaaggctggatccttaggctgtctaccagatggcattccagtggggagggagggagaaaggaaggaagggaggaaaggaggaagggaggaaaggaggaagggagggagagggggaggaaggaagtctcccagttacatattaatggcttctcagggtctgacttgtctttgctcctacactcatcttgccagtgagccctgcaaggaatgtggacagtcaagctacaggctgctggccatggaccacctcttgggtagacgagaagagacacatggtgggtgttttacagacatgtaggtaggaatttgcaaattgaaccagcaagtgtctggtacacagtaggtgtttactaatgggagttgatactgctattgacaatgtgagaatgagtggctgcaactgtcatcccactgagtgaaaagcggggttgattcagctgagccatctggcaacacgggtgttcttccttttttaagaaagttttgttttaaagtattatgaaatatgacacacagaaacccataaaccataagcaactgcataaggaaaaataataaagcaaagtatcatgtaattgctaccatggaactacttccctggttaagaaatagaatattgtcaacactcagaagctgacaccccaccccatgggtccttaccagtcatgcaccttccccaacccacaaaagctgaccttgatcctttcatggaaacgacacatttgcttttaagtaaatatatgtatgaattgtatatatgtactctcttcatatgacctatatatccacatataaaatctatatatttctaaatattatgattttgtctgtttttgaatcttatataaatgcactccaacatgatcttttgtgtctcacttctttcaggcatcattatggttgtaagatttaaccgtattgttttggaagtaacagtttattagttttcatggctttctagtagctctttatatggatatgcaacactttgtttatctattctcctttagatggccatttgggtgtttttcaggttggtgtaattactgacaatgttgctatgaacattcttttatatgcattctggggtatatacctaggagaggaattgctgggtcacaggatatatgtgtgtctatgaataactctagtagaccctgccaaactcttccgaagtggttgcataaatttgctctttatcctcaaggtacaagagtcaccatcatttcacagcttcatggacagatggtactggttgtctaaatgttagccagtctggttggtgtgtggttgtacttaattgtgattttaatttgcatttctctgattactaaagaggttgggtaacttttcattgttttttgtccatctggattttctcttttatgaagggcctgtttatttctttggcccatttagaaaatggggttgttcaccttttccttaatgaattttatccagatagattcttgattgtctcaagaggcatctattgaaaagagtggtgtcctgaagtccatgagagttgattgttaaaatttcaggagttttctgagtaggttgtgaaattgctggtagctcaaagtcagccacagtgttgataccatggaaactggcaaatgcgatataaatcagggcattttccgctagagagttggttgattactacaccaatggaaaagcccatcttttctgccctggctcacgaggccatcgctgtcataaatcctggtcatacacatatggatttatttcactgctatctcttctgtttcattcctctctttgtctatccccatgtcaaaaccacactgccttgtaaactacaggtttataataagtcttggtatctggtagagtgggtcctctcatctcctaagagtatcttgctcattcttggctcttgacatttctctgtaaatttagaatgagcttgccaagtgtttacagaaaaatctgttgaaattttaattacattgaatctatagatcaattttgggaagaaatgtatgtttttatctgctttgagttcattatggaagttactcattactgtgtaaaatcaattgcatatatattctataagctgtcatttgttatttatctttatccacagtctttcttgctctattggtccattttcttactgctatgaagaaatacccgagactgggtaatttacaaagaaaaagaggtttaattgactcatagttccacatggctgaggaggcctcataatcatagcagaaggtgaaggaggagcaaaggcatatcttacatggtggcaggcaagagcgcatgtgcaggggaactgccctttataaaaccatcagatctcatgaaacttattcactatcatgtgaacagcctgggaaaaacccaccccatgattcaattacctcccactgggtctcacccatgacacagaggaattatgcgagctaccaatcaagatgaggtttgggtggggacacagccaaaccatatcacttgccttgcagaacttttacatttttgttaaataaagttcatcaaacttttcctttatagcttctaggatatcgctcctagtagccacaaaggcaagccacacaaaacttaaaatgtaatagtagccacattaaaaaagtaaaaggctgggcgcagtggctcacacctgtaatcccagcattttgggaggctgaggcaggtgaatcacccaaggtcaggatttcgagaccagcctgaccaacatggcgaaacccctctctactaaaaatataaaaattatccggcgtggtggtgggtgcctgtaatcctaactacttgggaggctgagacaggagaatcacttgaacccaggaggtggaggttgcagtgagccgagatcgtgccattgcattccagcctgggtgacgtagtgagactccgtctcaaaaaaaaaaaaagtaaaaaaaggtaaaattatttttaataatatattttatttaatccattatagcaaaatatgatcatttcaacatgaaatcaatatataaaaactattcacgagataatttacattctttttttcatacaaattcttagaaatctggtctgcattttatatttcagggacatttcagtttggactagccatatttcaagtgtttattagtcacacgtggctaatggctgccatgttagatagctcaggtcagtttctttgttaaggcaggtctacagcagtcttaggtctgtggctagtttagtgctaccaagatctggcccttccagggttggttcagtgaggtctcttcactattgttggttgaaactttaatgtttcacagctctgtgtgactttgggaattgtttgtcttacagcccctgaattaccccctagccctgcaagttgctctttcttcagcatattttgcctagctcttggagtttcatctgcacatgcccatttagtatttggcaaaaggctcaagaagacttctgcatagctctctggaactctttctctgtgtagtttcctccttttcagtactcttcttcgtagagtccagtagcctcctcctgaattccagtctctgactccccaactcagtgagatgactgtgctctccttggggttccttctctgccccatggtctgcaaagtgcctccacacagcaggcctgggtgatcccagggcttaccttattagcttatcttccctgagagatcacaatccatgctgtggtgtgggtctggggttgtgcacaggctgccagcctaatactcattattcttaaggccagaagcagaggtcctacttaaaaaaaaagtcttagctggctgcagtggtaaatgtctgtagtcccagctactcaggaggctgaggcagaaggatcacaagttcagcccaacctggacaaaatagcaagacccaccatctacaaaagaacacaaaacaaataaggttttgagcttacttattagttttactatctagttatttcgtaattactttgatctttattaatcgcttcttacagtcttctttaatattattctttttataacttgatgtatttttattctttcttattagaaataattagggctatgagtttttctttcagggattcctttagctatttccacaggttctgacatgcaatatttttgtggtcattattctctagataatctgcaatttgggttttgcttttctctttgacaaagaattgttccagagacttaaaaaaagtgtattttgagatggtagagttttatgtttcagttttctggttttgttattaattttagttatattgtattacaaataaagttatctacactatttataatttttgaagatgttttaagttttcgttgtagcttaataatcatgacaaacctttgtaaacaagatgttattcactttttactgtaaattgtttatcgactttaaatgagtctgttatcaatgttagtatataaaataaatttaaatttacaaaaatataatgcgtgtgtgtgtgtgtgtgtgtgtgtgtttactctgggtgccagtgtaagattatatttcaaaaatgagattttttttctaaaaaaatgtgaaaaccactaggcaatgtgacttcaaaagtcatctagaatgtgtagaatgggaatataaatttgtgcaggctctagagtagagtgagccttgagttgtgttgagatcaaaggatacccagagtatttttttctttcatttttcattcattttctttctttcctctacacaatatgctaataaaacatctagattacacagaccgaggccaggtgctataccagtctgttatcaacaagtgagagcacatgaaaccgtttttaattggccttaggaaaagcagaggtgaaatgaaaatttaattctcctggaccttttttcaaaatgtatttttccatctctactgtaaagagtgcattttaattaggttgattctcactgtttggccatgcatttgtaatctgtgttcactctttgggaaagaagaatttgatgaaaggaacctgataataatggaaatcttgtctgagcagaacaaattggaattatccaatatgatagggatgtgagaagcattgaggctggtgactgaaaaaaaaaaaacacctctccccaaaacaccactgttctgcctagcacagtcttgtcctggcacagggagacagtgcaatagcatggaatgtgcttttggtgcgtctgggcctttctggtgcatcacaatcccccatcctcaatttccccgcctgtaaaatgggggtaataatctccactttgcactattgtgaggattgagagaaatgaattatgtgaaagtgcctgacatgttataggggctcagataatgagtaagaggagaatttccaaggaaagctctatggctgggctgagggtgaggttcctagtttgtttacagctttgaaaagaaagaagtgagcaggggcaggcatttacgtgtaagtgagagtgtgtgtgtgtgtgtgtgtgtgtatgtgtgttcagggcaggggaatctgtgggtacatcctagtacagtccagtgtttctgtgtgtgccattcaggatgaatttcctgtgggatagcaaacaaccaggctctgccgtagagaagtcgattcagagtcctcatctgcaagtagaaaagccccaggagtccatgcttacccccattacgctactcctgtgagtgttgtgggacagatgaaaggtcagctaggtccttcagctgaatgcagtgcactaatgaggaaacgagttaggagtttctccaccagtgccaacaagcaggtcaagtagcacacatcgggggtggagaggccgcccacaaaacacattatttagggtgctatgccaacctgtcagagagggaaaagatacacttcttggctttggagcttgtgatttaacagaacaaagaaagagaaaacatgaaaggcacatatgaagctaattttaaagatccagtggccatacagcattttttttttctcctagacagcattaaaatcaaataatccttgaggtcatcagacaatagctccagtgcactgtgcagaaagtacagtcctggccgggcgcagtggctcacacctgtaatcccagcactttgggaagccgaggtgggcagatcacctgaggtcaggagttcaagagcagcctggccaacatggtgaaaccctgtctctactaaaaatacaaaaaattagccgggtgtagtggcacgcacctgtaatcccagctacgcaggaggctgaggcaggagaatcacttgaacccgggaggcagaggttgccagtgagccgagatggcgccattgcactccagcctgggcaaaaagagcaaaactccgtcccctcccccccccaaaaaagtacagtcccatgtttctatgtgcaccattcaggatgaatttcctaagcacctactgcattcccagaattaggagtacaaactcaggggtcagactgatctggattaatttccaagtctgtcactaaccattttttaaaaatcatatatatttaaggtgtgcagcatgatgttttgatatacaaagtgaaatgattaccacagtcaagcaaagtaaggtgtctgtcatcttccacagtgactttttgtgtgtgttgcacctaaaatggactctctctgcaaattttcaatctacattgcaacattattaactgttgtcctgtggctgtatgataaatctgtagacttattcattttgtcctttgacctacatgtccccatttcctctccctcccaggccttggtaaccacctttctactctttgtttctatgtatttaactttattttatattccacatctgagtaagaccttgctctcactcactcttttatggccttggggaagcataggtcctccagacagcagaattgcttcatctttaaaatgattgcatcgatgtggcgattgggataattcagagatgttttcagcacagagggcttgtgctaggcccctagaatgtacagataaaggggatccatgttcttcctttgaggcagaggttctgactttgactttgccactccctggcaaggggcatttagcaatgtctggagacatttggctgtccctatggatgtgtgtatgcaggtgctaaacatcctagaacgcataaggcagccttcctcccccttcattgctcattccctctgattgtggaattaaaagacgaaaatgggtccattcgagggaaaaggtcatgatccttaatgctgtttttacatgacggccttgtcagagccttcagctcctcctgctgtcttcgacgttctaggcacagctccctccggagggcatgcttcccacctggggcttgctggcggagtgccatcctcatccatatacatgtccccaattaaaagacgtcccgctgccgggaaagcggctgcaccttggagcgaaactgaaagaagagaccccggggtcttcgcgtccctccgtgggaaggcgaggcagggccctgcgcagaacaccggcaggctctggggaaaggcagggattctatagtgaatcctgcaagcctgcttggggccgacttcctggagcagcggctgcaagcagcgcagagcccagctgtccttggcaaacaccccacagaggaggcgagggcttgctggctcctctgggacgccccggtcaagccaccaccaaacgggccgtgacctcgccttcgaagggggcccccagggcagcggtggacgtgggggcagtgcgggcgagaggaagtttgtctttctcccagctcgggagggtcgccagcttccccggggctgcacctccttgggacgcttgtcgggttggagcgccgcagctgcctctgcggctgccgcctgggtgacggagggtggggcgggggtgggtcgctcgtagctcgagagccacgatctgatttcagggaccgtgcctatgtgctgagtcaaaccccgccgctgggctgggtctgcagccgggccgctgagcacaatccgctgtggttaatgattaatcgctgaccaccccgcctcccgcagctcgggagagggtgctctgggaatgtggaccggggctctcaagtgccggcagctggaaaggaagaggagtgctgcgaggcggagtgcgccctcggcgaagaggggcagaggcggagcgccaggtgctgcggtctcactcccagccagccaggagtttagaacgttcttcctccgccctctccccgcctcgccccagccacatacactcccaaacctcaacacccaggcgcctcctgggcctctcctaggttgggctgctccagcaagtttccatgaaagcacctgaaatactaagttaccttcgcgaggagaactcgagtgagataaaatcgtgcgcccacgcaggtgagtttgcagccaagaattttggacgctgctgggaggagaaagggaagttgagaaagtctttggacctggtagcctggtgctctttctcatggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgagtgagtcctaagtcgggggcaacacgtgagcagcttcccaaccttcccccacgacccgtgccactgcctgtggccctctccagggcaagtcttgccctagaattgcacacttaagtttactaaggtggaagagtcttgtagcagtatgagggcattgctctgggtctctgaatgtttcttctctgtgtttcggggattcatggtagattatggtgaaaagagcacgagaccagaacccagaaggtttgggtatattccagaacatcactgctgtgacctttgggaagtcacaaaaatctttggtaaaatggggacaataatactagagaatatgacggacaaattaggtaatgcaggacaggtgaaagtcctttgcaaaagaccaagttctgcagagatacagggaaccgtcttatctagctcttttacccggggaagactttcttgtgcaattagattttgttcccatttttctcctcctttggagaaagcaggctgtgagcgacacacactctcgggctgctattttattccttggagcctcttcgacccaatcttaagacatgggagctctcagcactccccagggcttgggtttctgccactgtgggtctgttccttaccagaccagagcaacctggcaggacggcctgtttatctgatccagaaaatctggcttcaccgattcctaggatttgaataatcacctcacagacccaattcttatgcttgttttccaaacttttgttgtgatacaagtatttaaagttgaggcctcgtctatttaaaaagagcccacaggtctgttgaccccagagccttcagaagagggacctagtggctgggagacaaggctttaatggagacacatgaaatgtgtgtgaacaaagggttttaaaatatatttttttagcagaaacaataaaaaggatgtattgtgcgtgtgtgaatcaaaaaggaatagatataacaaacatttcccttcttccctctcccctgtggcatcaggaaaaggaataaatcatggtgctgtttgttttggtgtgggcaactgggcagcaggttccagggacaggaggtagacatgagagagagttggaaggcacttggagaatgatggaaagacctgggtcttgcctcagaccagcccctggcttccagtgtgtcattaattgttaaaagcttagggtctaattttactctttattcgatttgaaataattgccctaatgaatttcaaagtactcagaggcagccatggattgcccccagggagctgggctttgagagctgtggcaggtgaccagctgacttgactttactctgtgtctgcacaaaatgagaatatttggatgctactctgcattaggggctgtgccaggtgactgatatttccatcttctagaggaggaatttgagacttagagaagacctagttcagaatcacctcagtgcagctcaaagagtcccactgtgcttttcagggcagagaaatgcatgtctgtttgtgactttcacaggcgtgtggtgaaaggaaaatgaaacaaggcaggactttgacaagcataggtaagcctggtggtgttgctgcctcttagggccagcctttctggaagttgtagtaggtaacgttatcttgggacttgggaagcgtacccaactcagtctatcacccactggttgctactactcaaatattacagagaggaatggacattgtatttgcttaaagcttgagtgtttgttgaaatactagttctcccttcctccataaatattcccttaggcatatcttaaactgtaaggtgtaatttatactttagtgtgagttaattaaatttcctttttttttgatcggaggagactggcatgagtggataagaattagggggtagataagcattagcaagtggtcttcaagtatctcccagtctaacttaggaattaaggctgcctttgaccaaagggaaaatcattgatttatcgttactctatttgaccaatctctgtgtttcctgtatttctctgagtagatgtctgttctccccacagcaggtgctccaagttaaagccagtctccatttgcagcataaaatcagaatgccacagacttttatttagagatggataggaccttggagatcatcagatcccattagtaattgtctggaatgagtttgttcttgctgctgctctcgttcttttcttctggctctttccttctttcctataccaactgtatgttaatcgcccactgtgttctcagcataaagattgttgaatggcaatcaggtgctcaatgtgcgataatgtcctgggggaatttaccgtttgtatttagcccattttctctgcggtaggttttcaaagcagttctcgcaaatgtcctcctctcccaatgaatttcaaagagcttttaaaaataggaacctcactaattaactcaagttaggaaataaattaatggagtgaagaggaagaaatcatggcctgcattcatcagattaattcaatgcaatttactttgtaagtttcataaaacttgtgctttggggcatttttaacccagaacaaatgaacatataaattgtttacaaatcgctgaatttaatatagtaatttagttgtctttttagtatttcatttcacagatgggtcaaattaaaataaatatttgcttatttcaaacattttaaatttaatgtgaaatgtaaatggcgacatatcacaagtagttcttggagctcttaaggcaataaagaaaacaattaagattgttcgccgctcgttgttaaaaatgctaacttctgcatgacagaaacaaaattcataaatctacgcaagatgaggaagcccatgtaaaaaatattaattttccttcatctttcactattgtgcctcagtctagtcgatgtgctgggctggtgaataaggaaaacacattgggaactctgggagagaaagagaggctgggatacctactagctctcaagcaatttacaggagaacacaatagtgatgcaaaagtgcacattcctggaaataggagtgtcttgtcttgcctcttgtcagcccagtgacaaatcagtactagacttggtttctgtttcaaggtttcagccagtgtggcatggtaatatttgtccgatgtcagaacagaggttgctggtctggatttctgcctcttctggaggaaaggaactgataatttgattatctgtcctgtcccttcaatgatgaggatgtgtaaaatgagacttcctttcaagcaagtctttccccagacctcccatcttctctttctgaagtctcctttggagttgttctcaatgcagatagcatccaggtctgtggacacttgtgtgtgtctattgcacacatggcttgctatcaagtgtcacccactcaaagtggaatgacaaagtaattttaaaaaaagcatagttttaatttgtataataactttcaagtgattgggactcagctgcaactacctcctagagaactagagggcagtgattggctttcaactatagttatgaaaaaagattttacagacagtcatgaggttattaaataaaagaaacatcatagaagattcataactctagaataattacactcttttgcattctgatttgctctcctgagtcagaaggaaagggaagaagttacatctagtggcagggattacacatcaacttggtttgctcatattgaatatagacattattcatcacgtgtatttggatggaacaaaggttagcagttgctgctgaaatgaactactctaaaaataaggttgatatacatttagatatttgtggcatggttcagggagaagcaaagagaaggagctcagaatcacatcctctgggtttttagaccacagaattaggtcaaaccaagcagggccagggaagaagaagagagagaagagagggtagagggtagaggggaatgagatattgacagtgggtcctctttacctgaggacaatcgttacctgaaaagaactcataaagttggttcctttaaagtggggttgaaaacatttgaaaagaggtctcattgggacttgaaagtgaaaattatgaaaagaaatttatttgtatgttacaaatataagttatagttacaactatatattaattcttataatgattattcagaatgaatccaatgtggcttgagggcacaatttttctaacaaaaccatctgataacctttgtgttttattttctcagtaagattataaaaagggcctctcttcattctttgttatttaaatcaccctcatggaagcacctatccttgcattatccttatcagttttccattctttcataattatctggtctaattcgagcaaatctttgcttgtcagtggcgtggcatttgaatcatctgtttcttcagcttccttttcattgacttcatgaaattctgtaccctgtgtgcaggccataaccaaaaatataattaatttaaaaaccaatccctatactctactgtatatttcgtattacacagaagtggatgccttgaaatgctttgacagtgcccataagaatttttagtagttgttttcttcactaggttaaatgcttatcttacaatcatgttttcatcattagttttcttagcaaaggctttttatttgatatgaaaggatatgtcaacacagtctttgagggaaataccatcaacattaaattagtgacttttttagtgtaagatattattttgactccaatgtttcaatatttcagaaaaaagttttgcctcaaatattttatgtttattaccctatttgtgatagctttcataaattgcaagtgtcctgtgatcagcctggcagacaaatataataatgctgcattatttttataatcaggctgtctcaaagatttcatttctctgttggagagatgcatagtttccgaggaaggggagattgaaatcccagtccccatttattagcaagcctgttcatctgtcagcctcctgggggctgctgaagtgtaataagagaggcctcagttgcacaaagcatttggcttattagtgctaaaaccattcagaataaaagccatttacgagttgagacagcgccgtggaagaatattgaattgggagtcaaggagcccctctggctgtacaaggcaaggtccgctggtctaccatttggaggacactgtcgactcctatcccttttccctctgcacatgtcccctgccaggctgcagccctgggaccactcaactgactctccacctctactcttggctatttactgaggactggagacatgattggtcatcctttctgctgcacattcttgtagatgaatagctgtcttctcattgtgtcctgacctggccttctctgcacatgtgttctcctggtgtctcttgctcttcttataaggatgctggtcttatcagattagggccccacccttacaactttattttacccgaattacctcccaaaggcccaatctccaaatacaatcacaccggggcttaggccttcaacatgtgaatttgcaggggacacagttcagtttataacaccccttaactgccttattccactggctccccttcaagttcttcaagtgaccatgactggctctcttcccccatgctgcctgtgtatgggttgtttcctctgcctggcatgcttttctatcttactctattctctacctgctccccacttccatccccttccccaggttaatatctttctcctctctcagatctccccagggaaactggcccatcctccctgacttcattaaacctcccacaaaacaagactcactgttgtcattttacatttaattgtgcaattactcgactgatgtctgtcttccttctaattccttgtggataggtgcatgccctaatttccctcaacactgtacctcattccagcatagtgtctagacatagtaggtaatgaatatttgttgactgaacaaatgaatgaatgagcctcagcttggaattgagaagcaatgttctgttttcccttgggcatgcattcgtatagaggtttatcattcctcaaaagtgttctggttcatctgaaccaaagatgctatctttgaaagggttatgattcctctgaggcctctgaagtcaaaccaacatgcaaaacatttaagatttgcttgcccctgagcaaatgaacactatgtgctaatcagaccctgaatgttagctttaaccatgtatatctgccagaagtaaccgtgagatgaaagtgactagggtggtgaatggtccttgttaaaatctattgaacaagatgttaaatgcaatgatacaactctacacattatttcttagcaggctctttcaccactttttaacaaggggtcctcaaggtaatgaggatacagtgggggtgacattttgaaaatattaaaccatgtgtttatgtctccaccttaaattgcatccacttgcagccatctctctcaagagtgagccacacttatcaccccagggtaggaataagcagctactgcctgggacaaaggtgttgtggatccatcctgggtccagaggatggaattactgacctctttagctgggcaattatcttaaaagccagactttgtgaaggatgaaaaaggattgcctaacttcatatctctccctttaatgtatcatgagcccagcctagtggactggatcagccagttccagatgaaaccatagctaaggggtttggaatttatccttggaagccattgcagggttttaagaagttaaacagcacagttggatttctagtgctgcccctagagtgacagcatttgttgcattccaatttgggtcaaagtacaggcctggctgtgtttatagaataaaaaaacagacaacccttcattggaacacagttctggcagagcagctgacactggtgagttctcctttccattaggcagacctctggcccttggtttctccaagtcttgctgctgccactgtcctccatggccagacagtgactgcttccattcagcaactcccactttcccagcacggaggcccaaaccgcccccatgttgctcaggccctgattaggaggtggccctagggagctaaactaggtcacagtagctctcacctgtcatctctattgctcaatggtctattcgttcttcaacgacaatctccagctacgaccaactcatatatctcccatgacaaaacttcctaccacttacactagcattctgcatatgatatatctcagtgcctcccacttcttccatgaagccttcctggactacgacagcctatactgatgttcctatgcatggtgagccatcttagacatttctcagaagggggcacagatgatgtctctcgactatattggaactccctaagatcagggacccttcactgttgtacatcttcaaccttccttactgggttgggggcagagtagccatgcattgcttgagagattgatggattgaagttctctgacagtggctgctgctcctgaaatggaggaaaagcaccctcactgtgatcctcaggcagctctcttggctctaccttcctttccttctttccctgtgctaggcagaattctgaaatggcctccaaaatgcctggtccataaggtatacgtatcttctcccagttattcaatcaaacactaatctagtgctgcaaggaaggaaagtaattaagttcccaaatctgttgaccttaaaatagggagattttctgtgtggatttaaccaagtcacatgagcctttaaatctgggtctagaggtcagaggcaggagaactaagagtcaaagcatgagaggcatttgaccagggagaaattctctgttgctggctttggagatggagggagctggcagagaatataggtaggttctaggagctgagcaccagcaagaaaatgggccctgaataagcttagaggtaaaattcccccccagaacttctagaaaagaattcagcctggcctacatgttgagaacccaggcataccttgcctggatctctgatctacagatttgtgtgctaataaataggtgttattttaagccactaaatttttgataattcactatgtaccaatagaaaacgaatggattcactgaactctgctgaaaggagctcccaggtaaacacatggcctaccttagttataacttccaagacaggttcaatctccagaagcttctctttgaaaagtctcaccttccaagaattgcctttggcccagccattcacagatccaccaaccacttgttggtcacctgctcagtgctcagtgatctggaagtttaacaagatccagggcaccatggaatgttcactggacttttaaactctcgtttggagaattacaaaatttgtgggtttgagtcccactggctggattttcagaatgctgatgccttgatagtcagaaaggaaaacagtattgaattgatcttataattatcatccttttggtagctctatttcgtcatagcctggcaatgactaggcgctgcataaaggtttggtggataagctgatgcctaggcagctctgctgctttccagagtcctcctcaccagaagggagatgcctgtacccctcatcatttggcttcagatggaaaaagtgtgtcagggaggaagccaaccctggtgctgaagcaagtctgaataacagaaatgtcttgggctaacagactttatcattttctgattttagagcctttcccgatttagaaacttgacaaaaagtcttgtttgtacttactgagtgtaagagccattctggcaagcagagggtttaacactcaggccactgctttgcacaccgcaaaggtggctaggtagttggagagcagtggtgttactggtacctaacagacagatcgggaggcaaggctgcagcatcaaagttgccattgtacttgttcagtgtctaactgtccatgaaactaacggcatgcagaaatgggggcaggcccagctgggagtgatgacgctcattaaacttgcagagagaagccactctctttctttagtgaagaggaaaaagatcaactctgctttagaaataaaacactttacacagggtgcttgagccagagatgaagtcatttgaatatatatatatatgtacctatatatataatatacatatataggtacatatatatataatatacatatataggtacatatatatatatatatatatatatatatatatatgaaatttttttttttttgagacggagtcttgctccgtcgcccaggctggagtgcagtggcacaatctcagctcactgcaagctctgcctcccaggttcatgccatactcctgcctcagcccccgagtggctgagactacaggcgcctgccaccacacctggctaatatatttttttttatttttagtagagatggtgtttcactgtgttagccaggatgtctcgatctcctgacctcgtgatccacccacctcccaaagtgctgggattacaggcgtgagccactgcgcctggcctgactttacatattctattctatttggttttatatattatatatgttatatattgtatgagtatgtaatataacataatatcttatacatataattctttggagacatatactcagcagaaataaaatttctggcatatttttgagtctactttctatgtgctgccattctgaaggattaaatatcacattgaaatgacagctacatctttttgttttttcagttacatttggaagagaaggatgggaaggagtctcagtaagttgcctaggctggagtatagtgactattcacagacatgatcatagtgtcctgaggcctcgaactcctgggctcaagcaatccttctgccttagcctcttggtagctaggactacaggtgtgcactaccatacttggcttttaagctgtacttcatatatatatataatatatatataatataaaattatatttaaatatatatattatatatagttatatatattatatatagttatatttatatttaaatatatatatatttaaaagacagctgatgggttttcactgtttttcaagttcaagtttacccttgataggggtgacaaatgagtcaccttggtgattgaagcttgctgtagatatcctctagagaagatgaaaaaaacttctgtaggaactagctgttctccttgttagacctggggttttcctcattattgaatctcttacaagctgacttcctccaagaagcctgcctggactggctttacccttctctcattattccagcagatcttcacatttcatttgtttgttcattcatcaagtatttatgaaacttaagttgtgcttaacatcgtttgtaccatagagatcaaaatgctggttcctcctttcaaggagcttaatacttgtctcattgggacatcaaagtataagggcagagccttgtagaagcctaaatgtaccacttgatgcagggtctgggttgtggctgtttatgaagtaagctagttctagtaaatgttctgccagaacttttaatagactggctaactgggcttcactccagagatgttgttagtctcgatattcacagtatggtccagggacccgcagcatcagcatcacctgggaaattgtaaaaggcagagtattgggccacacccctaccagttgaattgtaatctgcattgtaagcagatccctggaatacctatgtcctaacatcagggtatgagaagcactgatctacaacacttggggattctttaatgtcaatactagaaaagggtgaattgggaaggactaaactcactagttgtgataagaactgtcaatcacttgttgtgtagttgtaacaggtgggaatttgctccatgacacttagacataaaaaagttgcattatttctaaaaagaaacttaaatctggctccaagctctcatttggaaggtggtgaaaatgttaatcttagtaacattgggggtcggggtttcccctttctcatgttgtgtcaaaattcaaggggcttatgagatgcccagaaaatgaggcattgggtctgttgttcaaagttcttcctattgccaattctgctctatgattttgctgccagggctgaccagagcactagggccagccagccaaagggctggcctttatattttatcttcaatcctcatagtatcattagcatgaaggtatcgttatcctcactttgcagaactgcctgaggtcatcaaacattgagattggagctgggatctggcatgttttgcagtccacgttctttacatgagcagagggtgagtctctcaaaagaaaacgctctgtagtctctcaaaagagaatactcttcagtgggggaacttgttttggatggtcagtgtcagggaggcaagaaattatgatgccaagtctggtggatgtttatcttgcttttaggctacccagcagcttttggctgctttttatctctgggaaatttccatctttttgagtcctgcttcctcaagatagtggtcagaagcttgctttcccagcatccctcacagccagagtgcagcatgtggcctgggctgcgccagtcacgtgcactggcatgagagtctcatttggaagagaaggatgggaaagagcagtagccacatggactctctttggggttaaagccagtgtgtgacaaatggggttaaaagagtgtaaaggagcctttagagagagcaaagacagaaaagctaaagacagcatcctaagccagatgtttgcagcacctctacattggtgcattctgatgggataaccttatgtgattctctggccctcctaggggttatatgaaataactaatagcctcatttctggatgaaactggaatgggctctgctgtttgtcctaagaactctgcatgtccagaaagtaggtaatagaatgattggactggagtagggaaatctagaaggtagcagtgatgaatttagactgaaaagtagactgagttaaatatggaggaagttgatagctaggctaatggattcagactatgtattggaggccatgggagccatggaaagcttttgagaagaggagtggcaggaaggagtgcaaaaacactgatgtggccatgtggccaaggtgtgtgttgctggcagagagaggcagtgtgaggggcacaggtgtggaagtgatcatgggttctgatgacggtttgtggttaggtttagtcatgaaggggtggtagttatcaaccctgctaaacattacaatcacctgtggaactattaaaaatgccctactccagtctatttatatcaaaacctttgtgggtggagccctggacattggcattatttaagccttcaggtgactccaatgtgtagccagggttgagaatgggagaagaaggagctggaaaggcaggctgggggtggctggggagaccttgactttagtaactgtgccaaggttctttgactagaggccaccaaaccggattcttcttatttagcaagtaagaaggaatttattggaagtatgggaggtagctcactgagtcaaagggaaggctaaataaagaaccagatttatcagggacctagggagtagaaattcatggaccaccagcttgggctctaccatcaagaaggtatcagcttcaggcatcatcccatctttgttgccactccatccagggatgagaaccttgttggactggctagggctgctcatccagcccctgtgaggctgagatgagggcaggtgatggacagtgccgtcaagactgcatgcagtgagaggcgtggtccccaaaggagacccatgttctacccaggagagcgggttacagagccagggagcagaaacaacagacaccccctgtggggaccttcgtaagcttagtgatgtgctctgacattgttgagttccttctttgttccatgcagactttccccagattctattctctcttatatccctggacttccccttccccctggctgagtcctgggtgatatttcccagggatctggtcatcttagtgcatgagcagtttagaggggtggggaggaggggtcagcagcagagcctcctgcttctgaaatgctgctgccagaagctggttggtgccaaatccccagggcatgtctcctgccttgtaagctgactcactcactcacctaggtcactcactgaccaagtatcaggttgtggctgctcattaccatgaaatcaggttgtatttgaaacttggcctggaaaacaaagatctctggctgtgcttcagcatcagatgcaacacctatttctagaattgggcattttctagttatgtcttaatatgatattggccttaagccaggactccttatttcagatgtaagatcctacctttgatgtcaagcatattgaccatggaaaataggaaacatatgagttgcattcattgccttctggaaatctaaaaagttatttaagaaagaaaaactagtaaaatttattaaagttttgttcataaaatgttttagtttcacattggaatgctgattgatctttgattttgatgtcagtcacattctgtctctagggcagttactgttttctctccctgcaaattgagaggccaggaggctgctctccaaggcagcttctcagagtcttcacttctcttggtgatgtttttttgaacgagagtcaccatacgccaggtgagccttccccgtggaacttggcagtgagctgtgtgcattgagaatatgtggagggagtgtggtgtgtgtggacttcacattcagtgggtagggcctaagtatgtgactactgtatcttaagtggtggggatgatggcaaatggggagtatattagtttcctgtggctgctgtaacaagttactacacatttgacggcttaaaacagtagacatttattttctcacagttctggaggccagaagtccaaaataagtttctctgggccaaaatcaaggtgtcagcaggaccttagagcttaggctttaggagagaattcactctttcaaccttccagttgctggtgactgctggtgttccttggcttgtggttgtgttaccccagtctccaaggccaacatcttcagatttctccctgctctgtcttcaagtcatcttcttgtttgtcttgctccatttgggctgttatatcgaaataccataaactgggtggtttgtaagcaacagacattattttctcagggttctagaggctgggaagtccaagatcaaggtattagcagatttggtgtctggtgatggcctgctttcaggttgcaaactgctgacttctcgctgtgtcctcacatggtggaaggggcaaggcagctctctgggacctcatttataaggacacaaaccccatgagggatgtactatcatgatgcaatcacttcccaaaggccacacctaataccatcacattggtgactaggtttccaacatacagatttgaaggacacaaaaattcagaccatagcatcctctgtgtgtgtcaaatctccctctgcctccctcttctgagaatgcatctgatgaaatctagggcctactctgataatgcaggatcatctctctacctcaaaatccttcgcttaatcacatctgccaagattctttttcttataaagtgacatttactgtatccagagattaggacctggtattctcggaggacatttttcagcctactgcagggagcaaagggataccagaaagtacaaaaatttaatgtggtacatgagcatagccttcccacctacagagagacactgctgtgcataggtatatgtcccaatctcctttccatcacctactagtgtgtgtgacttgacaaattactcaggacctcagttttatcatctctgcattagacataaactggtctaaggttgatttgagcatgcagtgagaagtatatggaggccacctgtgcagtgcctagcatatggtaggtcgtcattgaaaactacatttgacccttgaacaacatggatttgaactacttgggtcttcttatacatgattttttcccaataaacgtattataatactttttggagatttgtgacaatttgaacaaacaaatggtaaagcttagaagtagaaaaaagttaagaaaaagatatgtcatgaatgcataaaatatatgtagattcttgcctattttattatttactatcataaaatatacacaaatcttttataaaaccttaaaatttatcaaaacttacatacacacaaatacagattgtacatggtgccatttgcagttgagaaatataaacaaatgtaaacatgcagtattaaatcataactgcataaaaattagctacagtaattttttgtagctacctcctgttgctatcgaggtaagcttaagtgttcctagtgtccacttgcaactctgtgtgacgctaatcatctcagcatgagcagtttgtctctccagtaaaatattgcagtaaaaaagtgatctcgtgggcttctcacataaatttcatcatgtttagtgcaaataccataaaccttgactaacatcatgggactcatacaaagtgccactagtggtgctggaagtgctgccaagaagtaaagtcatgatatcacaagaaaaagctgaattttgacatgtactatacattgaagtctgcaactgcagttgccctccatttcaagataaatgactccagtgtaaggaccattaaaaaaaaaaattcatgaagccgtcacttgcaagaagtattttgcaaaaagtgtgaggttgtcatgcctgctattactacagctatgccagcaggcatgacaacctcatactttttgcagaatagttttttatattgtattggaaatgcagcttttatgttggtgcaggattgctattagaaatagcaattgctatagactctaatatgattcaagaaaaagcgaagtcattatatgacaacttaaagcacaatgaaggtgaagggcctaaagctggagactttaatgtcagcaaaggatggtttaataattttagacatttggcttaagaaatgacaagataacaggagaagcagcttctgatgatcaagaggcagcagatgagttcctgtacaccattaagaaaatcattgaggagaaaggatatctgcctggagaggtatttaatgcagatgagagtgctctattctgaaaaaaaatgccatgaaggacgtttattagtaagaaagagaagtgagcatcaagatttaaggcaggaagggataggctaactctactgttttgttcaaatgctgttgggtttataatcaggaactcctttatttataaagctgctaactcctgagtcttgaagggaaaagataaacaccagttgctaagtcttttggttgtacagcaagaaggcctggacaataagaacactttttctggattggttatgttgatgctttgtccttgaagtcaggaggtaccttaccagtaaggaactgccttttaaaattcttttaatattggacagtgcccttggccactcagagccccatgaggtcaacactgaaggtgttgaagtggtctacttgcccccaaacagaacatctctaattcagcctctagattggggccataaagacctttaagtctcattacacgtggtactctatggaaaggattgtcagcattatggaagaaaaccccaagtctggaaggatgacactattgaagatgccatcattgttacagaaaaagtcatgaaagccaccaagcccaaaacaataaattcctggtggagaaaactgtccagatatgcatgacttcacaggatttacaatagagccgattcagaaaattataaaagagattgtggatatggcaaaacatcaggtgggggtgaagggtttcaagatatgggtcttagagacatacaagagctaagacaccacaccagaggaaataacagaagatgacttgacggagatgagtgcttccaaatcaacgccagatgacgaggaagatgacataaaagaagcagtgccagaaacaaatggacaatattagacaatctggccaaagcttctaattattcgagactctttttggcttcttttactacatggatcattctatgatacagacacagacactgaaagtaaagcaaacggtgaaagaagggctggtaccatatggaaacatctttagagaaatacaaaggcaaaaaagacagaaattatggtgtatttctgtaaagttgacccgagtgtgcctgcctctcctgctccccgcacacctccttcaccccttctgcctctgccacccctgagacagtaaaaccaacccctccttcctcgttctcctcagcctattcaacatgaagatgatgaggatgaagacctttatgatgatccactttcacttagtaaacagaaatatactttctcttctctatgattgtctaataactttctctttctctagcttactttatggtatgtatacaatacatacacaaaatatgtgttaatcgactgtttgttattggtaaggcttccagtcaacagtaggtaattagtagttaagtctttggggagtccaaggttacatacagatttttgactgtgcagggaagggtgtgttagaccctgaatgcctgcactgttcaagggtcaactgtagttgcctatagtgaccttgtgatattacagaaagaattttggttgaggactcaagagaacttggttctagtcattgccaggccacagacttgtaacattttgagcaaatctccacatattttctcgtgtaaagcttgaagtggtaaacttgaggagtttgtctcaaaagtccccatagacataagacatgaaggggatatgggttccagacttaagcactccaaggaatagaaagagtgtgaagattatatagtaaagatgcatggacatttgcttttcattccattgtatgtcaatgtctgatacaatagaaaaatgttttaagttcgttttcagaaagcaaaagtgtcagcccaggaagggcaattcctgatggctataaggagcctctgaaagactctcaggtggccccagctgtgtgctcattccagaaagagagctttaggccctgaggccccccgagtccctaagcttttgaaattgtttgcctttgacctttgtcctgtgagaagttactggaagagcaagagcagcagctccaggccctggcagcccattctaggcgggagcttttgacaaattaccacgttgatgccttcttcacgcacctgtaaggccaaggcattattggccaaggcaatcgatatatcaaaatgaatttttggaagagtgtcatcaagctcagctttatttccaaaacaaactctgccccagggagggaaaaatgactttcactgtgaagtaaacagttgattgtttagacattacttatgtcatgctagtccatctgagatgtaggcaccatggtaaccaattgtccccagaattcatatttttgaggcccattaaaactcgaggctgctggagtcatgttctccgcattttggccattttaataataataatgagaacgttaaaatgacatttggaatttatatcacacttgtctgtgaggtgctctcagcactttacaatgtatcatccatcctcatcacagagatgggaaatatcagaggtgggtagtatttgtgattatattcagcttagtaaagagccccccggcttgaaggaatttcagtgatgtggcatggtgcttgccgacttgtggggacagaagaggctggtgctggcttggtgcttctgctcggtccatctctctctgcctcagtttccatcaatcaaatcagataacagcagtgtgtctcctcatcccgcagcgtggttatgtggatcattgtattaatcatattaactaacgttttaaaaaatttacttgctatgtgccaggtgttctaagatctttttgtatgctcattcattgaattctcccaaggccctatgaggcaggtgcagttaattatcctattttagagataagcaaattgaaacacggagagtttaaggaacttgcctcaggtaacacagcaattaagaacctgaggtgtatctgacccaggcaggttggctacagagcttgcagtattaaccactgtgttagagttgcttaaactttgatatagcaagacaatacacacacatgcacaagtgcacacacccgcacaggcagagcaaacaaaagtttcactgaacgatattcacccatccttacctttgaatgtgaagtgcattttgatcttttctcttctattcatttcattaacgaaaatgccaatctgaagccagtaaactgagtttatgatcatgagtaagtctgacatacattttgaaagccttagcactacaccatactccttcatagatgctcctggggaagcatttgagaagagacatgcagggagtgtgtgtgattggctggggagggtcgtggagaccagaatgtgtgaagtgtaggccctggctctgctcccacggtgctacctcctgaggcagctgctccgtgtcatgtctgggcctgtgggttggcgggcagaggctgccccactctcctcttctactttgtgtcataatagtctttgggggtcttctctgccagcctccatgggcttcagctctgagttaaccccaggtatttactgaatagacattatgtactgggcctcgtaggtatccagctctgactgggaggctacagagaggcattagacatgttccttgactgcaaggaaattgcaagacaccagggaaggaaggctgacatgtcaagggagaattaggggcaggtcccccagtgctgtatgtagggagcatagattttggagctagatggctcctcctagtaatgtgacctcgggcaacatacttgacctctgagagcctaactctggggctgcacctgcagcctgagtgatattatcctggctagtgaaactgtttggtgaaccatgaagtgttactaagaggttagtatttagaggtcatgttgtcataacagtattgccaaaagtctggcaacagccataaacattggggtttcagggaagggacggagtgttgcagcaatcctggaagccttcctggaggaggcagcatttaatctgaagcaggtattttcagttcctgactggaaggatcatgggtcacttagagatggaaacagatacgcaaggtccaaccattcatgtagaaaccatgcttatatataattaggtcatagctctgactccaataggaggatcctgagtgctttcataagttgttggggttttgttgttgttgttgtttgtttttagagacaagatcttgctatgttgcccaggctggccttgaactcctgggctcaagtgatcctcctgtcttagcttcccaagtagctgagactgcaggctcaagtcactcagtacactgctttcctaagtttgacatgccctgctggcttgaggtcactggcagacaaccacttgattcccttaggtcaggggttagcaaattacgtatgggcaatccctgtttctatatagctcatgatacctgtaatgtcagcaagctttttttttttttttttttttttttacatttttttgagtgttgtagaaaaaaaaatatgcgacagtactatgtggtcccataaaacctaaaatatttactatctggccctttaaagaaaaaaatttaccaactgatgccttaagtctcaaagtatacaatccttgtttcaagttgaaggtcttccttagttctgcatcatcctttagtcattctccaggcccttctgtcataccctgagggtacacagggcccaagccctggagagaaggggaaagtaggcctccattagtcatttcctggcttccatggctgtcggaattcccctgctctgccatggcagcatattaatatgtcgcagcgagcatgtgtatgtttaattctgatgacatgtggcgcataagtgattagtggcaaatgccaaaatgctaggctggagccctgatgctattcataataacattcataagagtattcccccaggatgcagctttctgtttctccaacataaatagcttgggaggccaaatcacaaacacgatttctcttcatgctccacctggccattcgtaacaagcattagatgtgaaatttgatttaaagcagcagttaaactcggaaaatcacaatggtgtcaagcccattgtttattttaaagatcaagagaaaaccaaaggtgagcaactaattctttattttattttatttttttgtggtaacagtgtcttgatgacaggctaatgtgcagctcaaaataaaggtacctgggtagaaataacccctcaaacatcattgaggcaatatgccaagaggcgcttggtaaatggctgtgaaggaggacagattatcctgttgaaaggctgctgagatgcggctccacttgacaatggtgggacttttgtcacaggaaaattagatgcctttggataggtctgagattgttcttatcttttccatatagcaaaaagctaccactcagaaagaaaacagagagttgaaggagtaccctgattgaatgccttccagaaaaaggattgttttgagagaaacactttaatttgcttcagatgattctgtggaggcttattgctgaagtggttccatttcagcacaggtttagctggctctgaagagagaagtgatttttaaaaatcttagggaatacaaagcatttatccattaacctgagtcaccaaccagttttcacaacaaggcagcctaggagctagtggtggccaggatatgttttgtttgtttggctcagtgtttgctgcttgttttttaaagaatttgaacaccgctggactgcttgtgctgtctccagtttctcacagcatgcccacttcctatggggctgctccaggctgcctcccatatttgtctacaaagggattggagtccaaggtgcattgttacagcttgtgggttccatcgaaacatgacacctagttattcccatcctactttgtatcttgtgaccacagaaccctcctaacaaaggtttgtggatggtaggtgactccctgaagctcagccctagtcctagagaaatattacagagtccccctgtgctgatggtaggtcacggaccctagccatctccaaaggacagagtccttttcttgctagtgcccctactgatagaaatgttgaacaaagggccagtggccgttttctagcagtggttaattgcagtgagttctattgtggcagaaaggtttgaaaaccatctctcgcctgccctcacaataacctgaattgtggttcttggttagactagggcaaaggggtggtgacatgagaacacgaaccctggagctggactgctgggttccaatcccagttccctttttgctccttcctaggggtgtgaactgagatgcaggggcagctttttaggggaaggatgtataagttgggtgacagattgatgcaggaaagaggaagaacaattggaaatggctttgacattagtttgaattccaaaagtgggcaagtaaataccaacgcggtgcttggattaatgagagggtggaaatggaaagggatccactagttaacaaagtttaacaaccactgacatcagggtcagtgtggaaggaaggaactcatggcgtgctcagccaaagtactttagagaatgtcctagtttgaaactttttcagtcactgagatttaaaataataataataataatggcaaaattgtcatgaaaaaaagtcaaaagaggctaaagtggctcagttgcaacaagacccaggaaggatatgagaggcacatgtgcccttgcagggcgtgactttccacaaccggtgtgtgtggtgggggtgctcagagcagtcctgccccacattccctccagcctacttgcctttgtctgcctgaaggacacgctcttctctgctgtttgtctatgtgggtaaaggtctcagccaagagaaatttttaagtaaattaaaaactcaagcaggctgatccatagccatgctcataagaagcctgcctcaagtgactgtttattttctttattccttgatttttttcacaaataagtatagttacatgcctgttatatgccagcctctgttctgggcccaaagtgagggtaacatcttcaacccctgtgtgctcccagaacaggaaatgagatgcatatacaaacaagtgggatgcagagccctgggagggatcatggtcagggcagacagttccctgtttacagatacgctgcatttcaaaagttagctttcaaactcttggttaagaatctggattcattttccagtacagactttcttttcatgcatatatgcttttttttttgttgttgttgttgttgcagatagcaaatgtttattgaatgcctaccatggaaagaactgaaaataccaggaagataaaactttgaatccccttcaagtcagggagtcatctatacttaacaaaccagcaaaatgaaatgctgggcttggtgctgtgtgtgggaagtggcaatggaagggccccaggcagggccctaatgaatggagtgattaatacacttgacttctttttctttttcttccccttctctatcacaccgaagcttccatttcttccatttagctgttatgctaggtgctaggaggaaagcaatagtttaaactaatttaagtttagatgtgactagaactgatgggagattgtcaataacctctgaggggaaactttctgtgtcttaatgatctaagactcaggcttggggttttatatgactgaaagtcacaaaataccttaatccgctcttcacgcagaggggagatcttgccgtgtgcttgcactcacacccatgaatttcacctgcttctggagatgattttgctccagttcctatggtgtgtgttcccagggtgtttctccttgaaaatgcagttttttttcttcattctttgctttgggacttcaggttctaaagtcagtgtcaaggcaaaaaagcctgtagagtcacaattgtccttgaaaatcacttagcaagggattacattggagacccaattttaccctgtctcagtgagtaccacccaaccactttttccttccctcttagaaaaagggacgtgattgttcagttggaaagcaggagaggtagttgggtccaagaaatagaaaaacacaaatcgtgaaacaaacatttcactcagagtggtgactgatcactcccttagaagcatgaggtcgttgcaacaaacccatgtagacaactgtagatgcccaggtctcatctcaaatttgctgcctgccttagagacatgggattctgcagttgagtccttatggctgggcgtgggggtggaggggggctcctttcctgtaaagagcacacagatgctctaaatgtccgctccctgaccgccattaacaccgctcaggccccagggaaatgctttccttcatctctggtcctgcgtccttgaaacagaaggtgggcctgtctgattgccaggaaggcttttggctcatgcccctgtgaaaggcagagtcagacacagctttggacttcagagaagatttaagcagcaaaactgcttaggtaagaagagaaaacaaatgaattaccttgtcggaggcttcctctcacatatcagcgatgcaatagattcatgtataatgaactgtggtttcacagcagtactgagtgcccatttccttgctgcttttttttcttacaatttgtggtttcggagatattcacagattcccaacacttgcacatggtgactgaggaacattttttcaacattaaaaaatttatatcgctcttcactctgcatatttaggcaatattgattctttgcattggcaactggagaggcatggactgctataattaggaatactcttattttttaaatggttaataagatttaatttacattaaaatgaataaaaattagctttaaatatctctgatataaatagttggaatatattcagtatagttaatattttatgttttaattttcatttacattttaaaatttaatgtaatttgaattttttattacaaatgttcaaattttatacattgaatacaatcacattttattttagaataaacattatattaaaactattgatttgaataacattagcaattttgctgaaatgaaagcaaggaaagttagttttgtgaaacaaatatataataacttatgaattatttatgcttttattgcgtaactcatccaatattactaaagtacagatggtacctgacttacgatggagtgacttatgatattttgatgttaggatgacataaaagcgatacacattcgggagaaagcactctgtgagtacccatacaaccattctttttttcactttcagttcagtattcaataaattacatgagatattcaacactttcctagaaaataggctttgtgttagatgattttgcccaaccgtaggctaatataagcgttctgagcacatttaaggtaagctaggctgagctatgatgtgggttaggtgtattaaatgtgttttcaacttatgttattttcaatgtatgatgaatttatcgggatgtaggcccacagtaagttgaggaatatctgaattaacagaacacccagacatgtacaatgattagtcaatttgctgatctttggtattttgtgactttcagtcatataaaaccctaactttaaacatatttttaaaattttgtcagccaggcacagtggctcaagcctgtaatcccagcactttgagaggccaaggagggtgaatctcttgagcccaggtgttcgagaccaacctgggcaacatagggaaaccctgtctctatcacaaaaatacaaaacctatctaggtttggtggtggcatgcacctgtagtcctagctacttgggaggctgaggtgggaggatcgcttgagcctgggaggtggaggttgcagtgagccatgattgccccactgcactccagcctaggcaatagagtgagaccctctctcaaaaaaatggtcattatgaaggtgtatttgtcagggaaggaggatagaacactttattgaacaattcatcagcttggtttgtaactttaaaatatttatgtggccttccatttgtattctcatactgactacaagtcagaattacccgaactattgaactgttacctagtctcactagcatatagttgaattctataaattactagtctatggcattatgggaatttttttttttaaagacagggtctcactcttgtcaccttaggctgtgcagtggtacaatcatagctcatagtcgcctcaactcttgggctcaagccgtcttcccacctcagtctcccaagtagctgggaatgcaggcacacgcccatacccagttgacttttattttttgtagagatggggttctcactatgttgtgtaggctgattttgaactcctgacctcaagcagtcttcctgcctcagcctcccacagtgttaagattacaggcgtgagctaccacaccggctatgagattttattctaacactgtgatttaattaggcttctgaactcatgcatctgctggagtctggcagtgtttggccgcttcatttaaaaacttgatgctaatggccaggtaattgtttcaaagatcaccattgatgaagtgtccagatctatcagccacaaatgctgtgaaggagagaatggctatcttccatttcctttgggtttgctgtacttttagttcagagtagcagtggcccttcaaggtttgaaaaagctgaaaacatcagagaggatgcagtggacaaatattgagtcagtccttattaaagaaaagaaatttttgagtgggcgacatatcccaaaaggtaccagtttcctaagagccagataagataagaacacagataagatctgtgtacagatcttaggtttatcaaatggcttcagctcccctaccgcccatccattccctttatttaaattgggtgtcaatgtgatagtttttaaaaaattatagaataatcatttaaaaatcattcatgactcatcatcctaacacacctgtttttattgttacatgttaacttactcgtacatgtaaactactgcattgttccaatcagcatccatatgttattctgattttttgttttaaatgttacattgtatatttttctatgttcccatagtccttataattcccattttagagtctatataatatgatgacatgattttacatgcctttttttgtaacatggaaatttgagaacaaaagaagaaactgattcatatccctagatcctttgagtttttattagtcttatcactctttaaaacccctactgacttatttccatgatgcaagcaagataatttgttaatcaaaagtttaattaacacacatactagagttacatatttattttaggccaaattttaaaatgtaatagacttaaccttgatatatggcacccccatgtaattgatgtatataggacatttatgcctgttttctaggtcttttctttcattgctttataaggctttaaaaatgtatacagggatttattgttgtgtcttcgcttctatgacaaattgtttgccatacctgtgatttatttttcactaatttgttcccagagaacaaccttgaaatgtagctctccaatacaatgctgaccctatgaggaaatgatgatctgccttctagaaacacattagggtaaacagtagacactgctggtatttgcaccaagtaccagtcaagggcaggcccctgtatgaataagaggcgaaggtcagtggtcaccagcgggctcaggaggagacaggggcttgtctggcatagcccactatcatgggcatttcgtcagtcacagagatcagcacaggagacctcgcaggagaaatggcaagccagaagcgggggtgtgttttgaggaagggggtgaagtgcagagatgtgactcctcagagaagcatgtgggcaagtcttgaaataacagagaaagaactagttagtagattaaagcagattttcaaattacatttaaaaaattctcttaattggcatagagatctctagaccagggcaatctacatttttattgagactctatactgagtgcccagcatggcaatagcgtactgcactcacccttttattcacccattaatagtgagcacccactatgtgccaggcatgtgctgggcctcagagacacaaagccatgaagaaatggtctccaccttccattttcttctggtgtaatgagaaagacagacacgcacataaaccagatgttgcaattcagagcaaaaagtcttaaaacagtgttagggccaagtgccttggaagcattcatttattcagtaagcgtttattgagtttctgttgtgcaccaggcattgtgctaggtgctggacatgtaggagagaacaaagagggtaaaactcctagcattgtggaattgacagcttggtgacgctagaattcctcttagagaaagaattttgtgcctctgcctgtgtcttggaaagcttcctggagatgctggcaaggctaagtttacagggcagtaggaatgaggaagtggaaatgaaggtgggataggggcagcaaaggagtatgggagagatagaggtggagcaggggcagtaatggagatgagatgggagcagaaatggaatggagtggagtagagagcagggatggggctgcaatgagggtagggtggagatagggtagattgtggggacagggatgaaggtgaggtggacaggcagatctttttctagtatgcagagacaagtgtgcaatggcacagaaaagtgaagcaacatggttagggcctgaatatatgccccatatgtaaagatccagatgacccagccaggtcccaaggggcatgtaatagtgttgggcagacaaggtgaatgcatgaaacgggcaaagcaatgccccacctggtcaagagagctgctgaattttgcacctttggttgtaaattgctcattagcagaatctgagtagcgggcctgttgcagtaaccgccagcctggtctctgtacctcggtcttcatccctgtcctatcccttctgtcattcattaaatatttactaacacctcctaagtcctgggcccagtagattctgttcatatatagttaatttaaagacaaagtctgtctccagagcctaggagctattagataagtttgtacaatcccaaggagttaagagctttctcaggaatagaaaccaaatctaagtggaatgtaaagaggagctggctaatattatcaggggcgctttgttgctgacatttcgttacaattttctgaatgcttcatgtattttccttcattcttaactgacatttttgctgaagcttgcttctcaccctcttgcttagagatatcttcagctgctaggctcaccgtggtccaggtccacaaatctctcaaatttgtattataactattataacaattaactgaacatgtgtattgggtgcctgctcagactgaaaactgcttaaggacaggagacttcttttggagccttaactaagaacattacaggtgttccaaaaatatttgttttttagcaaaattggagcaattagaaaagaatccattaagtttagcaactgaagcaattagagaataattcatttttaaaaactttagaatatcagagttaaagtgtatggcttggctttttgataaagctattgacctttggattccttttgtcaaattctgactctccaaatatcaccagcacacaaccagttgaggagagaaaactgaatttattgtttgctgcagtaaggaagaaaaccaccttgacagctttggtggtgtcttggaacagggcaaagcatggttggaatttgttgagaagtggaagtttgatttaaggcagacctagatctttcaatggggaggacttgattagaatgggtaaggatcatgatagaaaagtttagaattggtggaaatagcaaggtaaggatttttgaggcagaagacttaaagaattttagggaataaactgctcttgatgaattctttttatgagagttctttgggtcctttgagaagttcctataatgaacagtcaaattatctgcctggacaagactctcctggcatactaagatggtgctagtgatgacaatgaaatagtaaagtcatgtatgtagacagtaagctgtgtggggtgtggatagttttggttctcacttgctagccaagcaggaagtaattgatggctagaaaacaaaacacaaaaggctttctctaacgttttgtttgggagtttgaattttcacttaggcacatgcagaggcaaagaggtctcctgtccatggaaatgtgtttcatggataagaagaggtcagtcgtcaggttactgggtgctgacccctgggatttgtcaaacacacgtcagcggctggcttccttaacggctttcttaacagctgatgccgagtgctgcctgcaatgatgcagtgagtttccatgttcccttgtttctgtgtcacatctttctcttgacatttatccttctatgagatgtttactaatgcagagacccaccagatgaaaatgtccaataacatcatgatactttatttcatattttattgggtcagaaaactgcaatgtctcttccatttcatgctgactgccaccaactcacttctaagtatactgtaagaatcatgcctttctttaatcatgcggcaaaatctcacccaaggaatctgaaattggtttttctccccttctgtccagacactgcagccccagacatctttttggtacctttctgagtaaaatgggaggacaatggtgtgatgcagatttcagcaataaataattttgtctcttacagccagctctccgcaaccccctgcaggctgtttgcaaactgcagtttttcaaataccaccttgcatggtattaaaccctcttgagctgagcattggagaatagtcaaaataagctattgagttctgggtgatagcaggtgggcagaaactgaagccagagctgccattgccacacggcaaggtttctgcaaatcgccttcctccccaacagagaatttgactctggtgctttcttttctttttcctttccttcgtgtttttttgtttgtttgtttgttttgttttgttttgagacagagtctcgctctgtcacgcaggctggagtacaatggcgcgatcttggctcactgcaacctccgcctcaaggttcaagggattctccagcctcagcctcctgaatagctgggagtacaggcatgcgccaccatgcctggctaatttttgtatttttagtagagacagggtttcaccgtgttgtggtcaggctagtcttgaactcctgacctcgtgatccgcctgcctcagcctcccaaagtgctgggattacagacatgagccaccgtgcctggcctagtgcttactttattaatggaagctgtttgaattttcatttggttgtcttgggtttgagggcttctcatcagcccttttttattgtttcacttttcaaaaacattccactttgcttctcatcatctttgttcctcagttgaactgagagcaagtgtgattttaatgaagcactgatccttttttttaagagcttttcagcaggcctagatgattggcatttattatcattttgtgtctgccttctgctcagaatataaaggaatcttggaattattttctctcttctcttataggcccaaaggggtctcacttctctcccccttccttgctttttaaaattttacatctcctacaccttctagcatcccctggtacaatctcctacaggcccttcaaaatcttttgggcacaagtggctgggctgagtcagacagcttggaaatgcaaaaaggcaggccaggcagaaagattgatggtggaatgtcagcttgctgccagtgtctgtaccatgtggaaccatcagggtttcccttgccctttgtctgttccaatatactttgcttatcacccaggctctggcaggtcaaggaagacctgacgtggcagcttctagggctgagatttgcatgaaagtgctggaatcaaaactacctgactgatgtctgcatggagctcataggtccctaggttgtaactgtacctgctagggccaccactgctgatcagcatagaattgatgcaaagcagatggccaccaacattgagctttctgctcagctcctctcctggctgtgcttcatagaatgcaaaggtaagtgggctttccactggcacctactttgtaatggacatttgattataggcacttggctgagaggcctgtacattttttaacatatttaccttctgacttttcatttcttatctgcatatggttgttacctacacctgggattcgtaaaagttcatcaggaaagcacatgtaaggtaccagaaacagtgccaggcacagggcagcctctctatagctgtttattcctttctttcctgcttccttcacctataccctctgacacctcagccaggctgctggttgctagtaggtgccaagggaatggtgctgaagtgagtgccctcagagaagagacaagaaagctttctgagtggggtttgaacttcttccctctactctgccagccaactgagctaacagaagttcagcaacagctcaccatttcctttgaatcggtgtctccaattctcagtcttcaaatagctccagcagacagcagggttttgtttttcctttatttagaaccaattatggtctggaaccaatttggtgaaaggtgcctgagttttccttagcaacctaattctgtttgccttatgtgcttgacttttgctgattttcagcccaaattccagctatgtccagtgctcaaaggtggatgccagaggaaaagggctggtgggatcaacctgccccaggtgcttgaacagaaatgctctgggaagaggtagaggggatgctattttttagcatggggctgtgggaagctctggaggctagctgagagccattgctatctttgaggctgtgtgtgtgtgtgtgtgtgtgtgtgtgcacgcgcgtgaaatgctttgccctttgatagtcacaagggtcacccattctttcattctgtcctctgataccttctcaccgccactctcccattactctctatttccactctgctttattgttcatcatagtactcacctctacttggcattatgttgtacagttatttgtttataacgtgtctttccaattaaatgtaagctctttgaaggcagagtcttgcccatgttgctcattgctctattctcagtgccttgagccatacccagtgcatattaggcactcaataaatattcattgaatgaatggatgagtggataggtaaatgtctttggtgtttgggacaccaagcagcaaggtgagaggttattatatgacatgggcttgacaacaggctacatagggaggaaacctggcagattaatgttcttttagtcttttctttctttccttcccttgcctctcatcctctactctatttcacttgttttactatattcttaggatttacctttgggctgttaaataaatttatttaccagtttctaatgatatcttttgacttcttagctatagaagataatacagtagcttcttccttccccttctgttagttatattagatctacattttcagggtttataatatttacctgtttttaatcataaatcccaacttgctttagtcttagtcctacatttaaatagattcagtcttcttcactaggcctttgctgttgttttccattcaactcttgggtggctgaaaacttcttcccctaatagtttcttcaagacataacaaaatgtcttgaattgttgtaagttcaaatatggttcatttcttttataatgaatgatagtttttgctgggtataaaatttttgagtcacactgttttttggaggactagtaccaaaggtatcactccactatcttctaatggtaaatgatacaatggtaaagtctgaggccaatctcatttttccccatcataaggaaggagtgactgcctgcccaaatattctttctttatctttggagtctcataaatgtactagattatggttgtcacttttttccaggatactctgtgactttcaagatgtagtcaagtacaatgtattcaagtcttcttttatttctggaaaatgtattgagttacacctttaaatattcttttatgtcttttgctaatcttccttacctatcattttctttctaatccctttaaatttcttatttccatttcattctgttcttacttttttcaatcactgttctttcctttctgtttctttctgtatttttttaaattatactttaagttctagggtacatgtgcacagcatgcaggtttgatacataggtatacatgtgccatgttggtttgctgcaccaatcaactcatcatttacattaggtgtttctcctaatgctatccctcccccagtcccccaccccccaataggccccagtgtttgatgttccctgtcctgtgtccaagtgatctctttgttcaattcccacctatgagtgagaacatgcggtgtttgtttttctgtccttgtgatagttagcggagaatgacggtttccagcttcattcatgtccctgaaaaggacatgaactcattctttttttatggctgcatagtattccacgctgtatatatgccacattttcttaatccagttctattcattgatggatatttgtgttggttctaagtctttgctattgtaaatagtgctgcaataaacatacatgtgcatgtgtctttatggtagcatgctttataatcctttgggcttatacccagtaatgggattgctgggtcaaatggtaattctagttctacatccttgaggaatcaccacactgtcttctacaatggttgaagtaatttacactcccaccaacagtgtaaaagtgttcctatttctctacatcctctccagcatctgttgtttcctgactttttaatgattgacattctaactgatgtgagatggtatctcattgtggttttgatttgcatttctctgatgaccagtgatgatgagcattttttcatgtgtctgttggtggcatagatgtcttcttttgagaagtgtctgttcatatcctttgcctaattttgttggggttgtttgttttttacttgtaaatttgtttgagttttttgtagtgtttggatattagccttttgtcagatgagtagattgcaaaaattttttcccattctgtaggttgcctgttcactctgacagtagtttcttttgctgtgcagaagctctttagtttaattagatcccatttatctattttggcttttgttgccattgcttttggtgttttagtcatgaggtccttgcccatgcctatgtcctgaatgatattccctaggttttcttctagtgcttttaggttttaggtctaacatttaagtctttaatccatcttgaattaatttttgtataaggtgtaatgaagggatccagtttcagctttctgcatatggctagtcagttttcccagcaccatttattaaatagggatgccctttccccatttcttgtttttgtcaggttggtcaaagatcagatggttgtagatatttggtgttatttctgaggcctctcttctgtttcattggtctatatgtctgttttggtatcagcaccatgctgttttggttactgtagcctcgtagtatagtttaaagtcaggtagtgtgatgcctccagctttgttcctttggcttaggattgtcctggcaatgtgggctcttttttggttccatatgaactttaaagtagttttttccaattctgtgaagaaagtaataggtagcttgatgcagatggcattgaatctataaattactttgggcagtatggccattttcatgatattgattcttcctatccatgatcatggaatgttcttccatttgtttgtgtcctcttttattttgttgagctgtgctttgtagttctccttgaagaggtccttcacatcccttgtaaattgaattcctaggtattttattctctttgtagcaattgtgaatgggagttcactcattatttggctctctgtttgtctgttaatggtgtataggaatgcttgtgatttttgcacattgattttgtatcctgagactttgcttaagttgcttatcagattaaggagattttgggctgagatgatggggttttctaaatatacaatcaggtaatctgcaaacaggaacaatttgacttcctcatttcctaattgaataccctttatttctttctcttgcctgattgccctggccagaacgtccaacactatgttgaataggagtggtgagagagggcatccttgtcttgtgccagttttcaaagggaatacttccagtttttacccattcagtatgatattggttgtgggtttgtcataaatagctcttattattttgagatacgttccatcaatacctagtttattgagagtttttagcatgatgggttgttgaattttgtcaaaggccttttctgcatctattgagataatcatgtggtttttgtcattggttctgtttatgtatggattatgtttattgatttgcatgtgtcgaaccagccttgcatcccagggatgaagccgacttgatcatggtagataagatttttgatgtgctgctggatttggtttgccagtattatattgaggatttttgcgttgatgttcatcagggatattggtctaaaattctctttttttgttgtgtctctgccagcctttggtatcaggatgatgttggcctcataaaatgaattagggaggattctctctttttctattgattggaatagtttcagaaggaatggtaccagttcctccttgtacctctggtagaattcggctgtgaacctgtctggtcctggacttttttgtgttggtaggctattaattattgcctcaatttcagaacctgtaattggtcttttcagagattcgacttcttcctggtttagtcttgggagggtgtatgtgtccaggaatttatccatttcttctagattttctagtttatttgcatagaggtgtttatagtattctctgatggtagtttgtatttctgtgggattggtggtgatagcccctttatgattttttattgtgtctatttgattcttctctcttttcttctttattagtcttgctagtggtctatcaattttgttgatcttttcaaaacaccagctcctggagtcattgaattttgaagggttttttgtttctctatctctttcagttctgctctgatcttagttatttcttgccttctgctaacttttgaatgtgtttgctcttgcttctctagttcttttaattgtgatgttagggtgtcaattttcgatctttcctgctttctcttgtgggcatttagtgctataaatttccctctacacactgctttaaatgtgtcccagagattctggtatgttgtgtctttgttctcattggtttcgaagagcatctttatttctgcgttcattttgttatgtacccagtagtcattcaggagcaggttgttcagtttccatgtagttgtgcggttttgagtgagtttcttaatcctgggttctaatttgattgcactggggtctgagacagtttgttgtgatttctcttgttttacatttgctgaggagtgctttacttacaattatgttgtcagttttaggataagtgtgatgtggtgctgagaagaatgtatattctgtttatttggggtggagaattctgtagatgtctatgaggtctgcttgttgcagatctgagttcaagtcctggatatccttgttaaccttctgtctcattgatctgtctaatattgacagtggggtgttaaagtctccaattattgtatgggagtctaagtctctttgtaggtctctaaggccttgctttatggatctgggtgctcctgtattgggtggatatatatttaggatagttatctcttcttgttgaattgatccctttaccattatgtaatggccttctttgtctcttttgatctttgttggtttaaagtctgttttatcagagattaggattgcaacccctgctttttttttttttttccatttgcttggtagatcttcctccatccctttattttgagactatgtgcatctttgcacatgagatgggtctcctgaatacagcacactgatgggtcttgactctttatccaatttaccagtgtgtgtcttttaattggggcatttggcccatttacatttaagggtaatactgttatgtgtgaatctgatcatgtcattatgatgtttgctgtttattttgcccgttcattgatgcagtttcttcatagcatcgatggtcttttcaatttggcatgtttttgcagtggctggtaccagttgtttctttccatgtttagtgcttccttcaggagctcttgtaagtcaggccttgtggtgacaacatctctcagcatttgcttgtctgtaaaggattttatttctccttcacttatgaagcttagtttggctggatatgaaattctgggttgaaaattcttttctttaagcatgttgaatattggctcctactctcttctggcttgtagggtttctgccgagagatccgctgttagtctgatgggcttccctttgtggataacttgacgtttctctctggctgcccttaacactttttctttcatttcaaccttagtgaatctgacaattatgtgtcttggggtggctctcctcgaggagtatctttgttgtattctttatatttcctgaattggaatgctggcctgccttgctaggttggagaagttctcctggataatatcctgaagagtgttttccaacttggttccattcttcccatcactttaagggacacaaatcaaatgtagatttgatcttttcacatagtcccatatttcttggaggttttgttcatttcttcttactcttttttctctaaccttgtcttctcactttatttcattaatttgatcttcaatcactgaaacccttacttccacttgatggaatcagctattgaagcttatgcgtgcatcatgaagttctcgtgctatgattttcagctccatcagttcatttaaggtcttctctacactgtttattcgagttaaccatcgtctaatctttttttaaggtttttagcttccttgcgatgggttcgaatgtcctcctttagcttggagaagtttgttattaccgaccttctgaagcctacttctgttaactcatcaaagtcattctctgtccagctttgttccattgctgtccatatgtggtgtcagtcagcccctactgggaggtgtctcccagttaggctacacggggttcagggacccacttgaggaggcagtctgtctgttctcagagctcaaacgtcgtgctgggagaaccactgctctcttcagagctgtcagacagggacgtttaagtctgcagaagttgtctgctgccttttcttcagctatgttttgcccacagaggtggagtctagaggcagtaggccttgttgagctgtggtgggctccgcccagtttgagcttcccagccactttgtttagttactcaagccccagcagtggtggacacccctcccctagccaggctgccacctcacagttcgatcttggactgctgcgctagcagtgagcaaggctccgtgggtgtgggacctgctgagccaggcatgggaaagaatctccttgtctgccagttgctaagaccttgggaaaagcacagtatttgggtggaagtgtcctgtttttccaggtagtctgtcacggcttcccttggctaggaaagggaaatctcctgaccccttgcacatcctgggtgagacgatgccctgccctgcttcagctcaccctctgtgggctgcacccactgtccaaccagtcccaatgagatgaaccaggtacctcagttggaagtgcagaaatcacctgtcttctgcatcagtcatgctgggagctgcagactggagctgttcctatttggccatcttctgtattcttaccagtcttgttttacttgtgttgcttcaattttgcctttatttctataatgtttttattttttaaaaaaaattcacttatttccagatttttcttagctcatatttcaaattcttctatcttatcacattttccatgagctcatatatatctactttacctctctctctctctctctcggtgtgtttgtgtgtgtgtgtgtgtgtgtgtgtgtgtgtgtgtgtaagtgcttcattaagtttttcaaaaatcatgacaaagtatttagtcacattttttgtatctgctccatggcaatagttctctgctgaatgtttttttgtttgccattacttttcatatttctttgcttatttttcctataatattgctttatagagcctgtagtttttccttcttgatgacaaagttttgaattctttgaattttccccccaggccatttgtaggaaatttgtgtagggaagagaagagaaccacattgcattcaaggaaaaatttttcttcactgcagtgttttgtatgaatccttttagccttcacctctgtccagtcaataaagatgagcaattatagagctgttcacaatgccaaatctctctcctccccaactcatgtgggaagactttttttctgcatatatgacatatctgtgtgtctccttattcaacccattttcacctgtttctcagaatacagctggttccaaagagacattgttgactgcattttagagcccatttccattgttgaaagtaagggattctgattctacacctctgggttgctcctcactttacagtgtacctttttcactccttcctaaaacagcaaccaaagaatatcctctctctgtttctgggctctgctatttttggtgtcctctctatttacttcatgttttacagttccatgtctcctaggttcatcacaggtagaatttgtgtttgtgtctcttgtttagagttattgttaaaaagggaagattgaatgttagtcatgtgctaccatatccaggtgggaaaacctcagccctttttgagaaatctctttcttcattaatagaaagcctgttttccaactctcctgattctccaggaagcagctgttttcttttctcgttctctccctctccaggtttccaagtgaggccagattccttgttcctcaaaaggctttaccctgaccacccatgcctgaatcctcattgtgctcagattccacactgggtgtagcttctactgctttgattgcaccacctttttgtatgtgtatattcctttttgtctaaataatagggcatttagggacatggtctggggcagaaacactctgtatcctctctgctactagcatgtcactccatgttgtaggtgctgcatacatgatcatgaattattcccttctagggaattcttattgaattagatagctgtgtacttggcatgcattatatttgacacatactcagtcacgaagacttgataatgcatagactgcttctgataaagaactgtgggtaagtgccctcttgaacttatatgacactgagcaatgtcattagaaataacttcagcttttagttgtctccaggattacgtagatcagtgatccttccaaaacgatacctgctagttacagcctttgggatcaaatcacaatgttcctggtagcctgcatcctgcatactttagtcatgttccagagtatcagacctaaaagtaaaaggagctaatgaggccagtgactctcacagggtttcccactgcttcctaagtagaagcattttaaaatttgggattttagggtaaatggtttgaaaaacaaacaaatgaaaaacctgcataggattctagtataacttcctagcaatatgtctcctcatctctacccttgctcccagactcctaaagatccctggtttagtccgatgcctgtgttttagctgtagaaagctggcacagaggggcacagtaactcatttaaggtcatacatcctatgcatttttcctgaatggctgtaccatttttgcccttcatgtagtccacagatggacaatttcttgatagatgaatctgatgtgtctgaaagttggcttatgctaaagttaggcttgatgtctgggctgggggagaggggagaagatgctgttgtagaaaaaaaggagtcattggagtagaatggaaaatgtacatttgacaccaatcaataagccaatgcttaaactgagatttccaaacatgataaaggggtggaaaagataaaatagtaattcaaaccatagcagcctccttgaccccagtcagtaggagactcagtggaacaaatggttgcttttccaaattaaaaaagaaaaaaaggtggcagaggttaatttccagtttctgggaaggtgtgcttaaaacatgatggatttgaagactctgccaacaatttctctgtctctgtcttttttttttccttacctttaactttcctgtttctgaaattctagtcatttttatttcattcagtatcaataaggtgcctacatggtaaccccagatgggaaagagatgcataaccccagagcacagccagctctgggcaggggcttgctcggggttgggctttgggtgtatgggtcagcaaagccgagagcaggctgccagggacatcctggaactcgttggcacagcccaggattttacatacttggcaagggagtggactgagaaggatagaggggtgtaacctgtgctgggtttggagatagggaactgggatgtatgagtaacttggaggatgtggactgacccttccaaggaaattccaaagccatctggctcccttggtaatgcttgccctagaataatcgtataagacccttgtgggtagtattctcattctgcagataaggaaaatgggatgctaataaatgaaatgacatccttgtgttacaaaagtcactctaaacaagtctcagtctacagccctcgactctgggctcttacctcacaactctctctactctatcacagagctggctttttctctgtgttaccaccggcagttttttcctagacttgctagctgcctagtatcgtgctcaaggtactgccatgtatacagtagttacaacattaattccagctgaagaggagcttattttaaaatattattgaatgtattttcaattttgaaagtaatataccaaaattcagaacatttagaaaaccataagatcaagaaacatttaaaataatctcaggctgctaacacaacagctgtaatcattttggtctgtgggtttttggtcattttcctcatacatttagcatttggaaaaatctgttgaaaaccatattgcacatacaatttcatttcttgctgttttcatatagctttttgtcgtaaatcccccatcacaactttaatggcaggagaatatttgtgaggagcttaatcatgaagcatttactaatcatagtattaaagcatttgattatattagttcaataagtatctgtcaagcaccttgtgcccaggctctcctggcagccattgccccagtgacagtcaccttgctgtgccgagggatttggaatactcagaaccacatgagtcagagccccacacacattagtgagaaccccccatatgttaatggaagccccagactttcattctggctcttcttccatcagtgggccatattcaggctggctgaggccaagatgcaacgcagtaagattaccatgggcccgtctaacattttctttataaattcatctccatgactgttttaatcacctcttattagccctgctcatgagggagggactcctggcctaggtttctggagatagccaaatatataatacccaacactggacagatgagatgtacagcagtttattaagtcacatttgctcacagcccagggaggacaccatgttgcatgcagggcctcacaaaggttgcactcaggaacagagtagaccaccagaggccacggacagcaggccttgtagtatcaagaggttgtggtgctccctgtttcttgtgaaaggatatgattggcttgtttgaataattttgcaggctggcacagaactgaaacctacttctcaggggtaaactgtaactgtgcctggtccctttgataagaagggttgttgggctaggggaccttatctaagggggcagagtagggaggggaagtggctgttaggccattcaaggccctcctgattttaccagatgtcaaggcagcacctaataatgaggcttaatgttacatcttacaccacaatgacaagaactgcttttcctgcctccattttctacagctctttcctcctacattttttttaaacactctggcctttgctgacttttctttgtgcagctgtctaatagtatagagtttaaagtcagccaaccaggcagtccaggctcagccacacactagcctgatggcattagacaaatcacttcacctctctctgccttggtttcctcatttgtgaaatggagatgatggtactaaaagtccttacctcacacagtttttgtgagaactaaataatacagataaagcatttagaatagcatctatatatgctatgtaggtacaaatattcctatttttacttataagtttataataataatgtgattctgctcttttcagcctttctactccctttctccaaggtaaacttaccacaagcatgtttccagaaaatgtactctgttcattcattcatgtatttcttcatttgttcatccattcagtcaacaaatatttaagatcctctgtcgtgcaccaggcactgttctaggtggcagaatccatcagacaatgaaactgacaagcaccttaggagctggggcttagtgtgaaagtgggtagacagaagataggcaagtatataaactgaaaggtagttatgactggcaaagagtgctctgaaggaagaaaataaaatgaaaaggaagccatcagagagacagcttggtttccttatacaaggcactgagagaaagcagggctagggttctctggtattacaggggtggtgtgaggtctttggagggcaacaacctctgttctcttgcttggtgaaagatacaagattcattaagattgtcttcctaagagtcgggtctttttttttttttttggtcttctttaaggctcttccctccccacttccctggccatctctttcctcctgtcaagaaaggtcctatcttgttagcccagtttatgcatcgattttggtctagagtcagggaaattaatagggaaagacaggagaagagaggcaagaaaaaggagaaggacctgctgtgtgaagttaaactcagtttataaaataagaagctttacaggagtgcagagagaggttcaaggaaaacaagccccagtgttatttattagttatgtattgctatataacaaaccactccaaaatttggtagcttgaaacaacagtgatttattatttctcacaatcctgtgaattgacagttaatgtctctgctggttttgcttgggctcactcgttcaaccacgggatgggcaggactggaatatccgagatgggctcattcacttgtttgcaagttggtgcaggctgcaggcttggacattttgatgtcttcatcctctaggaggccagaccaacttcctgtaagcagcctcagggcagcattccaagatgatgaaggcagaaattgcaagacgtcttcagtcctaggttctgaaactcacacagtgtcacttctgccacattctattggtcacaggaagtcacaaagccagcccagattccagctggtgagatagatgttaaattaaaaatcacgtagttcttatttttgaagctgtgaaagggagctgaagaagaagtatcacatgagcttatccatgacgaacgacatgcccaacactgagccatcatctggattgatttacttccccttgcttgggatcatgcatatacagacatggctgttggtgttcagttgtgtggtaaaagtttaacatagcagccttgaagctggtgtccttagagaagctcgtgtgcaggattggcctatgacgggcatctgggaacttgaatctcaggaggatcccagtattccctaaggatagtgcagtatgcctagactatttgtacaaacaacctagtttattctgatcactcatttctagctaggaatctggaccattggtgcattttagacaaatggtatccatgagagaagcccacattaaaaaccttcagcactaagtctctcactagcttctcagggcagaaacatctcactcatgctgctgcagtttgttgctcagggaaaagtgggctgtatgtgagctctcaggggaaggagagagaataagcaagcttgtgcatggatttccccagacccagcctgtgtccttccctcctatgacccggcagtatatccttccaacattgctgcaataaattgtagtcaagagtacaactacatactgagtcccactagtccttctagcaaacctccaaatgtagaggtgctcttggagactctagcatattagtcttgttctcttacacgttttgtcttctatgaagatgggagccaattcccagggggcatggggcaataccagaaaattaccttgagggattttatgctaagaaggaaatgatgtcctgtgtcccttaaaccaagaggtcctagcaggcctggtggctgtaagccaatgtttcaaaatgatgatttgacttgcttattcacaaaatttgtttggatttgagacataattcatttaattagtagcaaacaggtggtaatttggaatatgtgaaagtgattggttctctctgaaacctcaaggaacagcatctttcactcaatgagaaggttaaaacaaaagcaaaaaaaaaagaaagaagtccctttgtcctgatcagatctgggcagtcgcctggacaaatctgtaaggatagattaccaggattgtctctacagaggagttccccttttccttgcttctaaaccaggtgtcgtccatcaaccagtcctctggagcccaggaactctggggcctgtaactacagtggagggaaagttagccatggaatgcaacttcccctagtctccctgtaccccctctccaaactatcatgctgctggtattggcaatgaaactgtctgtgagtgcattggcactgttgtacagtaagtaatcacagccattactgtttcctggggagtccctggatggcaaagagcatggtagccaataaggaggcaaagagcatggtagcctaggaggaggcatacacatctcccttggcaggtttacagtggagttgtcaaacatgctaaggttgtcacagcgtttgaaggagaactacttactgctttggaatgggaagagggttgcataaaacaaaaagtataggatttagaatttaacagaggtgggtttctttttttgcctaccacttaatagcttatatgacctcaggaaggttaattaacctctctgatccttaacatcacaaactcagagtggttgtgcaagtaaaatgaggtggtgtatataatgtatctgaactgttgcttagcataaaataactgcttcttaaacttgggtgatgaaaatatgatatatttttatttttgcttatatgtatagtattgatgaaattttctgtaatgaacaaatatttgttttataatgagaaaaaagaggattttttttaaaagcttaaagcctattttctttccttgccagccttgcaggctgtgtcttggctgagcctttctgagtcattcatgcttagcatactcttgagcttggctgtctctgagcagtcattgtacagtaacatccacaggggtttggaagggttcatgtcttaactgaatgactgaagaactgtttgtcactgacataggtaaagtacctcaaatattttctcaatatttcagtaattataatttgaattaatttttcatccagaatcattttctcttagcagagtcgctatcacaacatttaaaaagaaagagagaaagataaaacctatactttctggatgattgtcctttttttcaaatttgagtttccttgcgatttatcttttgtttcctttccagctaggaatgaaatgcatttttcaggaaaggtcagggtaggctccagcaaactttgtagctctggggaacattcccagggccagggttgactgagttctgtggtgtctgttgagaaaatctctggcaagtcaggcttctgggctgctcctctcctgcagggtaagtacaaagagggcagcataacccccaggctaacaggcctggacccttttgaggaaactaaacacataggcagagtgagctgagtgagaactcctactgtgtgcaaattagttgctgggtgtcctctggtcttttctttaagtctataacattttagatggagaatgacaggtagaaaatttcagggctgttttttttattgcaaatgtgtagaggaccaagagtggcatctgtgcccagagagcacttggcctctcaacaacttgagctagtacattctgacttgcattatgattactcttcagtatgcaggagctctccctcccacactagagtgtgaactgatttctcctgcgtgacaaggtcaccccataacttcatgttttatatttttttaacatttttaaagtacctgccaaaaaatggtgcttatatgtgtttgctaattgacagtaataccctagtaggagttgtaggcagtgaagaaatattaagcaacagccaatattataagaaattttcttggaccccttttggagtcaaagagaaccattacaatgtcttagtcttatgggagggccaagaggagtgtgtcagtctacaggcaggtgttgagcatagattcatggacctagcagagcactggctcctgtggggcaatcaaaagctgcagacaagcactgtggttgcagcagaaggccattatcctaaatggactaatgcaagaacagaaaaccaaatactgcatgttctcgcttataagtgagaactaaactttgggtactcatggacgtaaagatggcaacagcagaaactgaggactactagagagggagggtcagagcagggaaagggttgaaaaagtaactattgggtactatgctcagtatctgaatgatgagatcattcataccccaaacctcagtatcacacagtatagccaggaaacaaacttgtgcatgtaccctctgaatctaaaataaaagttgaaaaaagaaaagtatttttgaatgaatacatcaatgaatgaaaatgaaaaaatgctgcagacacaatctctccatagtcaagttggtgagctacagttactgctcatgaaactttaatgaataataaagatgatgtatacttttaccctaagctgtatggtactaaagtcagtgaaggcagggaacatagtggcccagaacagttaggaaggttttctggaggaagccagaatgaaactgggatacaagggtcagttggtatctatatttatttactcttcatacccctttagagggagtctgcttccacttttcagaagcctcagagaattttccaggaggaattagatcatgtacccagtagccctgagctaataaaatctggttgttaaattccacccttttctcattctccctcaagggtcttgtaatataatttgcatttctcaaatctcagctcctggtaccattttcttagaagtcctgcctcccagcacctcccaacactctgcctgatacttggcatgatgggaaattctttttttttctgctaatatttgtgcaggtcccatgaaaataaacaatctccaaaattgaacttgacccaaccaacatatttcaagtacctgtggtttcactatgtgtatataaatgcagatgcaacagtgaacagtttcctgtcctcaaaaagagtttaccttctagaccaggaaaagaaacaactatactgcagatagaatgtgagagaagctacaacaaagaaggatgagattaactgcaataggggaagcttttgtggaggggataggactggggctagtccataatgagcacctgaaatttacctatatggaagtggcagggtgggagagagggacatgctagtcagagggtacattgtggacaggcacacagaggtgaccagtgcagaaatggtccaggtttggctgaggctagggatgtgaatgagtgtcatggcagtgaagactggaatgatgaattgagtttggaacgtgagactgagaggttgggccctatactttgggtcaacccaacctttgcccaaagggttttaaacagaaaacagaggtgaattttaggctgctgctctggccatagcttacgtgtgcagtggaagcaggaggtggttacagatggaaggtggggcagggcaggtctctgtctggcagtcactggtgcaggtcgttatgaaggctgaaagtagggtagtggcgatgggcctggaaaaaggggacagatgagagagaggaggcagggtgacctttgcttgtctttcctcctccccaggtgagatacattgtcacgtaggcagtcatttcaggattgcaggaagctaatgatttttccccacaatgttgctggcttccaaccagagaatgttgcccttgagatttgacaatgactgttgcctccttggcagcgattctgaatcaagggcaggagtcagccttgctgggaagttgttcagttgattcaaagggcttgggacatgtctctgagactgtaggtggcaattcctgcaagttgcttcattccgttgtgtctttcccttgggtggagcctcctcttgccctctgagtggggccagaggcccagttccatccccctgtaggcatcagaaaagggctgcttcctgtgttcagtttagagctctttaaagcccctgctgacagatcctattcaagctaaaatgagtggctgggggcaactcatacataatttccttctatgtagtgacttcctgcaccatggggtctgcatgatttctgttcatttaatgaaaggttatattggcaaattgttatccttgggagtgtgggtgtgcagggagtgcttttggaatacattacagggtaattccctttgccctttattgcctctgcaggccatgtgtaattgaatcgcaaataacacactttagaaacaggcagagagactgaggcctgagcgtcctttggctttaatgagacagtgagcgtgtgtgtgtaaacgaccctctggttatgcgggccaggtggaagaggtagtcgtataactaatgggagtgatttttctccacctgccccagacagtgcaatcagcagccttcactcccgcagggagggtctcaatccagtggctggctctgcctttgaaacatccagagggcccattactgttaataggagcctctcccgagcacctgctagagactacctcacttacatgctggctggtggggttgaggtggccccatgcaactttcccgttctcatctccctccccagaggaggctgctgtgcccgaagttctgtgcatgaggaaaacaccaacagggggaaactgttacggcaaagttgcccactctcagaggagttggcaaaagtctgtgaagttcagagaatgcaaggtctttaagtgtggggaggtgaaagggtgggatgcagcaggggattaaaggcaagcagtgattacatgagacggtgtgatgtcttaggacactcagcactgacccccaactgggcaagagctgtgatcacaggtggatatggccacctctagtctaagaagtgtttgtccctgaatttgagggactgggtgttaatacctttgtgccccataacatccttccagttagtggtggcaccagcatttctgcagagcagaggtgtgagactgccatttgtgagggatgggagtgctatggagggaggagatgaaggtagacaggtgttcattttcagtagggtagttagggtgggcctcgatgaggtgacattgcaacaagtcttgaggaggtgaggcagttagtgatgaagacgtctggggaaagactgttccaggctgagggaccatggtggtgttggcacttcctaaagcagctgtaggcctgggtgatccaggactacaaaatgaacggggcaagtagggtgccgagaggtggggttggagatggattataaagtgctctgttggccgctgtaaggatgctggcttctattctgagtaaagggtgagccattgtggttgttgagctgtggagtgatatgaaacagaaatgaaaatagacgatccagtaaaatgaggaaaatgtatagatccagttgtacaaaggaagcatttgttggggggcagggagaggggctgtctatcccagcctgggcaggggagacagggagggcacggaaaggcttcctgggtgggcgggggagggtgtcagctgcatttgtccagggtcttaaatgatgggccagcctgtgacctcccaacccccacctgacactgtttctgtaaccaaggcagcaagggactagtttctctcctgtggattcttgggcaatttgtgtggtcctgtttgcaacctctgtgtgtgggaatcaatctatgcctcatcctttgggcataacctttgcttggaatccactttctatccactgacccttggcaaatcagtacccatgtggatatcttgcctagcaggatttccttacatgctaatgtgttactgagcactgcaatcccagggcagtgggagtgtggggcaaagaaagtgaggccagggaagtaggcaaagtagaagcaagggggtctgttgcaagctagccacagcctcacaagaaaatatagccagttttctggtcacatgagatgtgaccaggaaatgagatgagaatagtccatccagttagaggaagagagaacaatttatttgttggcacctgcctgtctcctcatactcattgataaagctctagtccatgaggatatagacctgttctactggcatgagtgcctaaagtggccacatggtagatagagcttcaagctcagtggaagctttactgtatccactagtcggtgcaacctctctaggaacctggtagagtcaaagtatgtggggttaggatgcacagcctccacaaatatttcataggggtggtggttagaatgacctctcctacttccatcacttggttcctgggtcagtttattgtagctgttgggaacacagtgtcacatgtcagccactggtttatcacctacaccacatcttgaaaggtagggcccagcccagcaaggagtttttttttttttttttcttccccataactcgttgccttaacttcactttcaataggctgctatgccattctgtcagtcagattgactctggggatggcaaagattagttagccccaggtcattgtcgtacttcctttgcaataaaatgggtcgcttggtgtgagacaatgttttcggttaactttcagtagatcaggcattttataagcctttgctcaggatttccaacaaaagctctgcaagccaggcagaatacccaagtccgcaatgtgtatcaacttcagcagggatagaccaatgttctttcccatgtggaaggggctcaatataatccacctgccaccaggttggtcttctcaaggaatggtgccatattgaggactcaacatcagtctgtgctgttgacaaattgggcattcagcaatgataacagatagatcagcactggtgagcaggagcccatgatgtttggtccatgcacagcctccattcctgggcaagtagtagggagtggaagagagatgccagctgacattcattaacatcatcttgtctaacttggctcctgagaactttatctggagtagattctctgccatggaaattcatgtgagatacaaagattttcaagcattgtgagcccttctgtaggtccctccaggcctccttgctgctggccttccaggtgtattccatccagctcctgacctatcagcaaatccacttgccactcccagaagttgatatctgcaccacaggccatgtttccctgaatacaaagtggatgactgagtgtctgccagaagctttgcttcctgggaggccactcttgagtgaggctatagttcagccacagtccatcttcaatgccaacatttcctgcaactcacctgtgaaccaggcccaggtccattctcctccatccgttggtcatagggaatggaaacccacatatatggaatgaaaaaaatggtgttggtactacagaggtaagtgacatggtagtgacctgaccatgaacttactttttcacgcaacttatactctgcatctgcttgagtctagtaccaaatataccactttaatcatataatggattgtgactacacgcacttggccttatgacttggtggatatagtattacttagcttgtaatggaggtcatacagtctagtgtttcaaggtcaaatgttagtttcagctagaactcagtaacacaagggagctattttttcaagtagaggacgtggccttgattaagaactctctaggtctgccctgagagtctcatatttgagcttgcccagcatccttatccaccgtgaacccccctgcaccaccagatttgctgcaacatacaggtcaagtagctgggcagcttgtgccactgcctgaacctgctacagagttctctgttcccctggtatcttcctgaatcaccgggtaaataaatttgagcagttttccaaagtgtggtaaacactgccttaaaattcaatgaatttcaatgagtgctgttcttcttttgtagtagcaggtgttctaggagcaaggatttctcctttagagcagtgtcccagcatgctccaagtcactggaagctctaaaaatgtcactgatttggcaggtcctaagtatttgtggcatttatctcccaccttccaccatgtatgtgttctcttagtaaattatctaagccacttcctgctcccccatgcaattattataacatcaagataatggacccatgtgatgttctgcagaatgtcaaggcaatcaagttccttgaggactagattatgacaagaaaattaacatagccctaaagctattatgttgaaggtgtactgtagtccttgccatggaaagactacagtactttgatgccatcactaatggatattgaaaaaaaaagcatttatcaactcagtagcaatatattcagtaccagagtccatgctaatctgcttcaggaagtatgttattttatctaacttatcagttagcattgcgactaccacttggctaattgtacggtagcttatggccatctgctatgctccatctggtttctgcagaggccacagatgaattgagagacatgatgtagaccactatctctgcctctttcagatttttggttgtggcactaatctcttcagttgttacaggaatgcagtattgcatccaatttatccaggcagaaaagaggggtagtttcagggggctgcatttagcctttattaccataacggctcttcctccacagtcagggaagaaacgtgagggtcttgctagttactaagtatctctataccaactacacacttagtgactgggaaataatccagtgtgggtcagtggacaggcacatgtgactcaggctaaagcactacgacatgacatcagtgtgtcctcacttcagtcagaggagcatggtgagtttttgaggtcctttggtattagtgtcagctcagaccctctatttaacagttaatgaaatttctgggttttctcttttctcaaaggcgaagttacccagcaaatgttttctttggggtgataattagaggcatattttctgcatatctctgcactggtgttacacaattcttcctcaaggaaacctaatcttttcttcagtctgctgtctactacctctcatggcctctagaccaataaccagtgccaggacttagcacagcttgagtaggggtgcacaagccctgttctaggaagtaatagatggtacctggaagggactgtaggacgtggctaatatatgctttggatatggagctttgggtctgtgagctgacttacgtctggaaactgggtgaggggactgtgattttctgctgtggaaactgatgacaaccttcagctcaccagcttgtgcatgcatgcgtggagtgtttgtgtgtgtgtgtttatttttgattgtacaaatcaagcaacaccctagtcaactgcccatctatcttgccccttgaaacaccatcaccatagatttctattgatcgaggcagcccagttgctactccagccttgctgcacattatgctaacgatgttaagggctgcttcctggcctttgccattttgggaacccattattgcctttagattaaggatctcggttccatggcagcatattcatggcaattcctgcctgcagtggacagccgccataaagaatctcaatgattcttgtgcccccttgatcagtacatttcttattgccttgttgaaggaagtgccctttgagtcctctcagagaatttatcatgtgatggggtctcaggttttacagagtaaatccactctaacagttccatccctctgtgccttctgaccccttcttcagaactatgctgaggaagtttcaatatcttcacccaatttactgtaggccatcattctgctcatggttcaaggagccctcccagtatggtatcaggactggttccaggtatccttatcagctaattgaatcccaagtctcaggttaatgttctcatgtcaatcaccatccccatctgtccctttcctttgctgagtagtctcttcaccctcaagagtcactcctgcatgcttgttcatgaacactgctagtatgtgttagcaaagttctacagttcatctagtatatagtctactacttcatagaatagggcctgtatatcactgtgcatgcatgctggcactggctattggtctggaggtcatgaggggtagttgggggcagatcttgggaagaataaataccattctgccatgcacctatttccaataatatcagtacgtgatctttcgacaagttgattgagggaggtgggggaactgttttcctctggcaatggggagaagcttctttggctggcccagagggttcaagattctccagcttaactacacgaatacccccacaccaggtttcgtagtcccacccttactcgttagggctctgattgtgacatacgagacaggtcgaggctgcacatttgacctactttgaaaatttaccacatggaaaagtcatgatctgggtctgattttcagtgcagttggccctgaagctgcaggagacaagagtctctttttctatggatacagaatctttgcacttttagaatatgcctgaagccagcaattagctggcttggtttcattttctttttgcaagacctcaaatgctttcacaaatagccatttcacactcccatcctcatagttgtcattatcttctgccaatcaaatgatgcagccatttgaccttccagtgtcttgcactttacctgcacctcatctcaatcaactgcaggtgaaagcttgactaattgtgatgtcaccacatgccacttagcagcagcagagggattctttttttttttctctttttagacaaatgagtatcaagaactgtgaagagtctgagattacactctagtttcaagccaacaccttacctttccacattcatggatactgaaggaagacaaagtcctttaactcgggcctagtagtgtcatgtcatttataaaagaccaaaggtgaattgtatcccaacagtcagtattccaactccaaaatcttataccgaggatgtcctggttccaaagtttctggttcgaagtccctagaaaacaaaacctgaggcaaaatgtatttcttcatgtatattgaaagatatattcccaggctgggcacggtggctcacgcctgtaatcccagcactttgggaggccgaggtgggtggattacttgaggtcaggagttcaagaccagcctgggcaacatggtgaaaccctgtctccactaaaaatacaaaaattagctgggcgtggtggtgggtgcctgtaatcccagctactcaggaggctgaggcaggagaatcacttgaacccgggaggtggaggttgcagtgagccgagatcatgccactgcactccagcctgggtaacagagcaagactccatctcaaaaaaaaaaaaaaaaaaaaaaaaaaagatagatatgtaaagatatgttcccagggcactgataacatggcgggaaaaggaagtgaggtagggatggaggaaaagcatatgatgctttatcaagctggccacagtatcacagacaaagacaaatgtaaaggagtccatttctcggctctgtaggacaggctgttattccttagaacagtcattcgtgggaaggaagggaaaggttggctctgccaattccttcccacagaggcactcctctgtgtagacactccatcctacccttcccagttgttgctgatggcctctccaggcagcctctggggaagtgagattcaaggccccacagtatttgcctctggctgtggtgggctatggtccccctctgcctgctcttctgcctctgacactaaccatccatgattctcgagatgctatcccatctgtttttacatggacccagtgggaataataattgctgcagtgattattttaaaagaatgttgtaagagagtaaacattttgaaaaattgtatgtgctgtagaaaaactagttgctatttatcagatttctcaaacttgagtcagaagaggaagaggaggcgcctgaacaggactttgaaggacgagtagaagatacatagatgaggacacaaggaagggcttctcaggtggagcattcagaggcgtggaggacaggggtgggagacagcatacaacagggccagcctgagcaacatagtgatatcccatctctacaaaagaggaaatatcagctgggcatggtagcgcatgcctgtggtcccagctactcgggaggctgaggtgagaggctcacgtgagtccatgaggtcgaggctgcagtgagctgtgaatgtgccaatgcactccagcctgggccacagagcaagaccttgtctaaaaaaaaagagccaaggctctgtctcaatcaaagagccaaatccagcccgccaactcattttgtaataagttattgaaacatggccacatccattcacttatgtgtcattgtgggctgtttttctgtagtttcaacagagaccatatggcctttaaaacctaaattatttactctgtggcatgttacagacccctgatgcaaaaggaaatattaagtatattacaaagttggtaattaatgaatataaattgcctttctcttttcatcttcctcctttgtctcacaaagaattgatcacataatggctacatagtaaacactgattagtgaacttagtctttggaaatatatttaataccattgcttactaaacagagttaatcctagaaatttactaatttaaaatcaataccataacctacaaagaatttgaggcattttattctatcccctttacatgaatcatattaataattgagacactgtcccacacataatcaccaactatttgaaatctggctgttctagaaaatctggaattaattgggacttggcattacaatgactctttaaaaaccacaaactgctgaacactgactgcgtttccacaggcagcaaagaaaaagtctgaaacattttctagattccttgaggggaggagttatgtcttatgtgacttggcatagaagggattaataaagaattgctgaataaataaagtgtccagaatagtgccgggcacaggataggttcttggtaaatgtttgttgaattatctggcaaaataatccattgattcaaatgaatgagaattttcaggccacagaacacagatcattgttagacccaagctaatgatctccataggttgcacacaagtaatttaaaatctacatctaatttatttgtcagaatgttgtataaccattggttggccccagatactggatgagcttcccaatcaatactacgtaacaagaaaagctacctgtcaaagacagaaagctcagtcaggagggacctcatggctgtgctgctttaaggctaattaactggtgtctgacatcttccagtaaatctaaattaaatgtattcttgtgaattctaatttcaagtgagtttaattgaacttgggagggaagctaccacttagtgagtaaaatgaaaatgaagtaattgaatatttttccagaattgtatttgaaatgtgctccatcaaatgttgtttcagaacccaagtgaccagctgcacatggttaatatttggaaagggaagaggagtatttaaatgtcagcttgtagccactagaagggtaaatacaatagccggctgttcagttactagatgtgagctctacttggcattcaaagctttttttttttcaagttggaagttcaataatgtgttcaagggaattaagatgagtttggacgactaaagcacaaaaaccaaaaccttctttccccacttctcccccttcccagcacacaaaaaggacagcagtgctgctgatttaaaattgcaggcattttgatgggcttaatcaactgattacacattaaagtgttgaaccctttatttaatgactatttattaaaggcccgtggtattccaggcactgcggaggatagacgattgaacaggacttagtctatggccttaaggaactttttgttccgtagtgagatgagacctgcgaattaagtggtatagaagaggaaaatgtgacgcatatggtaagagcaagcaccaagtgctgaaagaaggtagacttctggctgtgaaaacaaagcactcctctcaggggaggtggtatttgagctgtaaatatttgcagaaggaaaagaaagcatgggacctacttggaggatgatgaagcatttaattgggctggtatggaggatttgtggaatgagacagtacgaaataaaatagctggtgtggttataaagatccttaagtgggtctgtactttattcagtacacggcctctcagcagggaaggggtttgatcagaaacaggaaagaagaatctagatgtaatgctcactatcagaaaaattcaaatccaaaccacaatgtgataccacctcatacctgttaggatggctactatcaaaaaaccagaaaatagcaagtgttggagagcatatggagaaattggaacccttgggcactgttggcaggaatgtaaaatggtacagccactgtggaaaacagtatggagattcttctcaaaattaaaaataaaattactgtattatctagcaatcccacttctggatatatatccaaaaaagttgaaatccaggtctcaaagaaatatttgtagacccacattcatagcagcaccgtttgccatagccaagagaacccttgggcactgttggcaggaatgtaaaatggtacagccactgtggaaaacaccgtttgccatagccaagagatggaagcaacccaaatgtccatcaacagatggtatatacgtgtagtggaatattattcagtcttaaaatggaaggaaataccatcagatactataatgtggatgaaccttaaaggcattatgctaagtgaaataagtcaatcacgaaaagataaatactatatgatttgacttatatgaggtatctaaagttgaaaaattcatagaaacagaaagtaggatggtggttgccagggactaggaggaggaggaaatggcaaattgttgttcagtgggtaaagagtttcagatttgcaagaagaaaaatttctggagctctgtttcacaacagtgtgaatgtacataacactactgaattgtaaacttaaaaatggttaagatggtaaattttttattatgtgggctttcaaaaccataataataataaaaagaatatagatacagcggcatggtatgaattgtattggggttgaaagagagagaaagtgggaaatcagtttagaggctgttgccctaggcttgatgagatgtaactagggcagggacaggaggaaggaagaggagttctcaagatagaattagtaggatttggcacctgcaggaaactcgattgaaggagagtgtcagagatggcttggaggttcccaaccaatgctaacgagaaaatgatggaggctttcccagaaatagtgacttatgtggggagataaggagtttggttttggattaattctgactgcaggttgtggccaattgtgctggagctggtctaattatactgtgtgctaagagctgttggaagctcttttttgtttgttttgcgttttctctcatgtttctatgtgtttgaccttcaacttcttagttggccttgctcaatggtttatccctaacttttcaaattaagggcgagttgcacattttcaaatgtgggtctctcaagagttcgttcactgaatccttcaatctggggttgaatatctacaggattggttgtaaaaattagggagctatgaggctttctttactgaaaaacaccgtttaaaaattttttatcctttttcattagaaatttaatttccaacctggtcaagtgaacacaatgcccttacctttttagtgtggcatcttattcgtctaagctggaagcagcctcagaggtgtgagcttatttctttactttaggcatttcacagggaccagaggtttacaaatgtattcgtgtcggtgctctataaggtcatcacctcaagattcccagagtggtggcagtagtagatttgtaattccaaatctatgtttccacagttgagagaattctgctgaaaatggaaaaggagggtaacgaaatagactggtttcaccttggcatggattggtctacaaagataatcacccatttgagtattgagaagtgtctttttagtgtttgctataccaggaggtaaaagaaacatttggggacattttcaaaggccaggatctgggattggaatgggatgcaattttaaggtcattattctgtcacttatgtcagaaagaatttttgttactgatatttgtgagcaaatgattgcaagtgctgacatgaagttgagctttgtttaacacattgcatacatatttcagccctgaaagactcagatacttagaaaattttccttaggctttggagaacaggttacattttgagacaagatttttatagaacaatatgtgactctgtaagaaattataaatacttttctgaaaatcagatgatcttggaggcagttccttaatgccactgctcaaccttggagaagaagatgaaattcacagcaatgctccagcctcagcatgccctcccaggcctcctgattttgtcaggaaatacttccttgaagattaaagctataattcagaatctaagtcaaagaagagtaccttatttaaacccatgattttaactcacagcaataaggccacagcagacgggagctgaacatctctgtagactggaccatctggaccatcacttgcaagtccttctctcaacattgttgacgtcccctaaataatggctctgcattgactggtgccactgtcccaagagtggttccatgctcagctcctttgcctgcctgtctgcctctctttgtagacaagcaattaactgattagatccagaccttagtatttgacttgtttctttttctctgtgtcatgggaattcacttcctgttttaggacattttcccttttcagcctgatggacctgaggattttttattcattcatttttgacccagtgttcacagatttttacactcatgtttctctgttaggtgcccctaaatgcctcctttagtgagatgccttttcctcccccaaatccagaattgttcatcctttttttgtagaagtcatggagttttctcgagtgagagatagtaaaaggcctggagctcgagctgggctggcacaggtacatggtggctactgggggcatcacttctaccacattacgtggatcaaagcaagtggacgagcagttcagattcaagagaaggggaaacaagctctaggttgggatgtggatgtcctggaggggaggaattgtggcagccaactttggagactcctacactaggcattaatttacattccctcacaaaatctttggaaacacaaatattttgataccaaactgttgacatcttttgggtgccagtgaacctatattttcttactctagattccttattagtagtagtttgcaaatcagataaagccaaaatagtttataacaatgtctgtttctccaccaatgctttaccttgtattaataaattgaaccttacccatgtgttctataaaaagaaattcttacagtgtaagtacttagtgactatttaaactgacctacagaattatcttccactcaatgttaagtaccacaataatatccctgcactgtgcacggcaatatagtgtagcaatggagtgcacggacctgagagccagattgcctgagttctgatatgaactctgccacgtactaactgtataaccttcagcaagtttcttaagccctttgtgagtcagttttcttatctataaaatgagagacctaataataccaccatatagggttgtaatgaaggttaaatgtgctcagaacagtactagacatatagtagcatacaggatggttcaactactattgttgttgttgttgtcattgttatgacagagcgatcagcactgaatgtttagggcaagtaatgtgagtgggacagttggaacagccaaggtacaaggtcacctctcacccatggaatgccatgacttctggcccacacttatgcccaatccatcttgcttcatccagctctagtgggtgcatggcacgaatgttgggcaggctgggcagccctgtgtgttgccttcacttccatgtaatgatggagtgcttttgtatgccttccatgttgtgaaagacaaagactctctctatcattcaggccgtgattggccgttctggtctcagagttatatggctaatgtcagtcttttggtgttataccagagcctggtaacaggctggtcttgtctctcaaaagaatatctaaccttagcccttgctggagttgttttagtccaggacacagttgcttttcagtttgttcacctatgggacatcacaaaatctccaaaatgcattcacattcatgctgagaaatccagaactgcattctcagccagggcctagggttcaagcctcaagaatgtttgtggcatctggagacctgcttcctggagcaggtcctactaaaaaaaaatgacaatattcctgggtactttagatagaggatactgcaaaatactcaaattggatgtggctagaaatatgctatcccaggaatccagatagtatgtcagcttttcttctgttagttggtggatcaaagtgtaggagtttttcttgaccttgatgggaatgtctccactccacccatacatttaaacccaaggaactgagttcaaaacacaggtcctggatcatgcctgtgttaatgacccatcttcagttccttaggcaactctctaaagctaagtctactttttagtgtagtatcaccttcactcatgatcactgatgtgttgcgctagttacaggcatgtggctggcaccaagggccagtgttctaatgagcatgcctatggccattgcaagatgttaacatatccctggagctgcctggtaaagagaattctgtgtcctttgtgtccagctgttcagcagactagaaatcctgataatgactttcttgcttaaaataagtttaaaatgctgactaaatcatttaaatatgttttcaaaggcattaatgggttagcaaaaaataaagaacctaataggccacaatgggcatcagagagatgttgtgaccccatgcaggcatttgccagattaggtgaacttggccattagttcatacagccctgggagacagatggacaagcctcagatgggaaatccaattggtccatccaaaatgggaactataatcggagactcccactatcccaatccatgttaagttaaaaccccaaataattgcaccttcagggtaagaataaagtaggaataagcctcaggggatgacaaggaaaattgcttgtctcaatccttgattctgagtggaagacaaaaattctcctataagaatttaaaatctttttataagaattcacacaccctcacacagtttatatgctctgacatattttgtagcctgagctcacactgtttagatggtctggaaaacctcagatagaaaatcgagtattaagttcaggttggttgtgccagaggcacctggcaagaggaaacaaatcctctctggaggaactcacttgtatccaagacctcagagaagtctcacagataatgtcagaagtgggggaaaatgagctcatattttgggggcaaaattgtgaaaccacttatggaaactgtactaagagtggagagcctgaaaagacagtgatttcagatacaggcataccttggagacatcgcaggttcaattccagacccctgcaagaaagcaaatgttgaaattaaacaagtcgcataaaatttttggtttcccagtgcatataaaatttttgtttacacaatctgtagtctaagcattgtgtctaaaaacacaatatgcataccttaattttaaaaagcttcattgctaaaaattgctaatgatcatctgagccatctgtgagtctttttgctagtgaactgtcatgccccaatgttgttgactgctgaccagtcaggatagtggttgctgacagttagggtagttgtgacaatttcttaaaataagacaacaatgaagtttgccacttcgactgactcttcttcaacaaaagatttctctatagcaagcaatactgttttatagcattttatccagattaagacttctttcaaaattgaagtcaatcctctaaaatccctgctgctgctttatcaactaagtctaagtaatattctaaagccttcattgtcatttcaacaatgcttataacttcctcagcaggagtagatttcatctcagtaaaccactttctttgcttatccataagaagtaacttctcgtccattcaagtttgaatgagattgtggcaattcaatcacatcttcaggctccacttctaattctagttcccttactatttccaccatatatgctattatttcttcactgaaattttgaaccctcaaagtcatccgtgaacgttgggattaacttccttcaagcttctgttaatgttgatattttgacctcctcccatgaatcataaatatttttaacggtatctagaatggggaattctttccagaaggtgttcaatttactttccccagacttatcagaaggatcgctgacagctatagacttatgagaagtatttcttaaataattagactcaaaagttgaaattactctttgatccatgggctgaagaatgaatgttgtgttaataggtatgaacattaatctccttgtacatctccatcggagctttcaggtgaccaggtgtcttgtcaataagtggtaatattttgaaaggaatcttgttttctgagcagtagtatcaacagtgggcttaaaatatttagtaaaccatgctataaacagatgtgctgccttccaagctttgttgttccattcatagaacacagacaaagtagatttggcataattctgaaggaccctaggattctgagaatggaaaatgtgtattggttttaacttaaaattaccagctgcagctgcattagcccgtaacaagacagtcagcaagtcctttgaagctttaaatcctggcattgacttctcctctttagctatgaaagtcctagatggcatcttcttccagtagaaggctgtttcacctacactgaaaatttgttgtttagtgtagccaccttcatctactgtcttagctagatcttctggataacttgctgcaacttctacatcagcacttgctgcttcactttgcacatttatgttatccagatggcttcctttcttaaacctcatgaaccagcttctgctggctttaaacttttcttctgtagtttccttacttccctcagccttcatagaattaaagagagttagagtcttgctctggattaggctttgggttaagggaatgtagtggctggtttgatcttctatcaaaaccactcagactttctatatgtcagcaataaggctgttttactttcttattgatatgttcactggaaaggcagttttaattttcttcaagaacgtttcctttgcattcacagcttggctaactttttagtgcaaaggcctaactttcagcctaactcggctttcgacaagcctttcttactaagcttaatcatttttagcttttgatttaaagtgggagatgtgtgacttttcctttcatttgatcaattagaggtcattgtagcattattgattggcctaattttagtatcattgtgtctcagggaatacggaggcctgaggatagggagagagatgggggaatggccggtcagtggaggagtcagaacacacacaacattcattaagttcaccatcttatatgggtatggtttgtggtgctccaaaacaattacaatagtaacagcatatatcactgatcacagatcaccataacagatatagtaatgataaatgcaataaattttggttattcttactgtatttcactggattatagtacagtgagaataaccaaaaatgtgacacacagctgaagtgagcacatgcttttggaaaaaatggtgctgatagatttgcttgatgcagtgttgccacatgtcttcaatttatttttttaaaaatacaatgtctgcaaagtgcattgaagcgaagcataataaaccaaagcattcctgtgtcagtattaatagacacagattataactaggtttaatatgcttaaagtaattaacaaaggaacttaggaaataacaaaggaatatgatgctttaaatgattaagcagagttgacaaagaaccaagttaaaattttagaaatgaaaattataatagtcaaaatttaatgattatatttaacagatttaacagccaattagacctagctttaaagaagattagtgacctgaaataaatctaaggaaagtatacataatgcaatccagagaggtaaagagatggaaaaatgagaggataagagtcgtagagggtagaatgagaaagtttacagatatctaatgagaatttcagaaggagaaagggagaatattggaaaagaggcaatatttaaagagataatgtacttatctaaaactaatgaaattaaacagtttcaggaaacatatttaatctcaagaaggtcacatcaaaaagtccacaactcaacatatcataatgaaattgtaatgccaaagacaaatgtaaaatagtaaaagaaaaacagtgtatatagctttcaaagaaaacagcccatttttaggtcctatttgccttccattttgaccagtggggaaactaaatggtaagtagacaaatttgcttacttctttctcctggacttactttctttctgacaattatttaagacctttgttaataggtacttgccttttggaaaaatcaagttgtaaactttttctccaaattaaaaatgaagttcttcaacatctcaacttgaccagatataaaacaattttaaaacctttaaaagcgtattgagaaaaaccgagcttttcaaaaacaacatgcctgtcattatcaaaaagaggcatatttaggtaaaaataacaaaaaaaaacccttgctgcatagatattgcaaatagttctagttatctggtcagtgggtaaaaagcaaggacttaaggtcttcagctccaatatcttgctcatttcttattgctggaatttcatatccttttcttcctgttggatgactaaatggagtggtggtggagatggtaagcccacatttactcagccacattctgctcagcctcaggagtggatgaattctcagcttttgtctctaccatcttgtcgtttggggtgttctgagcatcagggctggtacttgaagttgtggctgccccgaggctgaagtgtctgctgaccctgggttcattgccttggttttccttacccatgtcattgctgtcctctctcggtcatctttggcaaggagagctcctgtggaaccgtggtctctagccccatccacatcccgcctcactggtttaccttgtgcccctgcgccctggctgtcagcacctccacttcttctccctgcaagggagggtgggaatactgtgattgcccgcaggttatctgagtgtagtgaggtgtgcaccctgtgggaccactgtcccatcctgttctttttctctctctcactattgaggacccctatgacgcggagtctatcatggttgcagcctgctccacgtttacctctttgacctggaattccaccagggcctgtgacacttgctgccagggtcctcctctccttagatgacatcgaactccacagtcattccatatcctaccctgcgaaggtacttcctggggttattcttctttacagcagtctggtacacaaatgcatcttcctcggtatcattcctcttggtgaaaccatatctgtttcttacgctgaaatattttattgtctccaaaaccttccttgcaatgaccttttccccattggcaggcgccggcgctgtccgtggtgctgggcttggtgccggcagcaccgagggcagggacgagggcggtgggggccgctggcggctcctgggccggggacttgctgctcctagctctggtgactgtgactggggctggcggcaggccgtggggctgctcagggttccctgcgggccgctccctcctggactttcttgactgtgtgactatattcttaattttcccggaggactttttgatgagcctttagagtactctgtgaacttcattttgactcatcagtgtggctgcaggtaccgggtaaggaaaaccttgggtatgcatggctggggtggggaccagagtagggggcaagacacatttgtatgatcagttaaataagagtgttgatactgggtggatcaaacctttattctaattctttttacatattttccttttatatatgcactgcagtgccctaaaaaatgccatattaggagtgctgtatttttaatttttagtacaaaaattacttttctgtattaaaaatgtatttgtattaaatttatgatcaatttagtcagttactgacagctgaaaagctacttcagagaggagaggaggctcagcctagattccctttggacacaggcccaggagcttgcaggcagaggatcagctctgggaggccccagagagagtttatggtgagcagaatcctcaccaggtagtccccaggcacctggcatgtggcaccgtgcttgctcctgtgctcacctgctttctgtcctgcagtcagcaagccactctcttctgccaaagcctggctcactggggacacaaaggtcttccctactagttgaaagagccagagaaattcatctcccttaaggaaggagaggagagagagaaatagaagtttggaggggcaggatgcagcctattaatgcacatatacttttctttgcttcactctagagtttggagatagcgagagatgaaaagaaagaaatggaaagggatattatgagggaaaaacccactaagaatgagatattcttaataatctaaagaaatccagttttctttttttcaggtcaaatcctgcttgtcctcggaattctttaaccatcagctgtagatttagaccgaggaggtttattcgatatttaacgtatacttaatggtcatctgctgtattccagacacttctacacaacggagggtttgatagtgaaaaagagacaaaactctttgaccttgtggagttaacatctagtcggagagacaggaagaaccagtacctagagcatgccgatcgctggtgaatgctacaaagaacaagcattaagtgacctgggaatgtgaggcaggagggggaggatgatggctattctaagaatgatcagggaggcctcagaggccagatgatgtgggcacaggcctgaacagggtgagggaggtagggtttcaagggactgagtgggtttgcttctagtagcccctcctcagccaaagaggagcctccagggacccctaatccaggctagacaggaggtactgctgtgcagcagcaagagcctctctaactccccaaatatccaccctggttggagggagatgatgataaacgtgtgagggctaaaggggctgcgaaggctctgtggagggcaaaggccacaaataccaggcccgcgagctgaattcataactgggcaccagctcaagtgtgaaccaccctggaaggaactgctctaatttgcgaaccttgaaccaagctgagccctaaattaatctcttttttttctcactgaactgagcactgaaccaaggattttttcaaaacagcaacagctagtaagccagtttgaaccagaaccaagcctattcattttctaaaagtattgaactggaacaatataggaatattaaagtatctttcgaactaaaccaggattgaactgatcattcacaagtgcccagcttgagaagagaagaaattctttttggagagacaattctgtgtatattaaatgtctgccttgagagtcattccctaccaaaaaattacactgccttgtgacctctttttaaaattttaatcttgggcctaattctaatatttaacttttcatttgtacatttcatttgcctacttattcaaatgttcttgatgataggaaccacattttgtattgcctggaaatgttagcacaattcctgggatacaatagaagtgtgggtatatataggggaataggggtgtaggagtgattggtggcatgcaatgaccaaaggcttgaaatttattctgcaggccagaggaaactgtggaagggattcaagcagaaagtggcaagatcagatttgagttttagatggcactgtggggaaggggttaggaatggagattggttcgaagtgtgtattatagtaatccgggtgtgaatcagtaaaaagcagtggtattgtgtgagccccagaggcagaaactgcctagattccagtcctagcttcacatgtccttgctgtgtgacctcaggcaagccacacaacttctttgtgcctcactcccctcccctgtggaaggtagatgctaatgatgcttactccatcctgtgcttttgaggtttatgtgatacattgtgtgtgaaatgtagagcactcagaatagtacctagcacatagtaagtgctcaaaaaaattcattattaattttcattgataaagtaattatatatatatacacagcacatatatatacaccacatatatatacaccacatatatatgtatacaccacatatatatacacaccacatatatatatacataccatatatatacacaccacatatatatacataccatatatatacaccacataaatatatacacaccatatatacaccatatatatacataccatatatataccatatatatacataccatatatataccatatatatacataccatatatacaccatatatatacataccatatatatacaccatatatatacataccatatatataccatatatatacataccatatatataccatatatatacataccatatatatacaccatatatatacataccatatatatacaccatatatatacataccatatatataccatatatacaccatatatatacaccatatatacacaccatatataccatatatatacaccatatatatacaccatatatacacaccatatataccatatatatacaccatatatatacaccatatatatacaccatatatacgatatataccatatatatacacaccatatatataccatatatacacaccatctatatatacaatatatatacacaccatctatatataatatatatacacaccatatatatataatatatatacacaccatatatatataatatatatacacaccatatatataccatatatatatacacaccatgtatataccatatatatacattccatatatataccatatatataccatatataccatatatatacataccatatatataccatatacacaccatatatacaccatatatataccatatatgtacaccatatatatacaccatatatataccatatatatacaccatataccatatatatacaccatatatacacaccatatatacaccatatatatacaccatatatacaccatatatacaccatagatataccatatatacactatatatactatatatataccatatatataccatatataccatatatacaccatatatataccacatatataccatatatatacaccatatatataccatatatacacattccatatatataccatatatatacattccatatatataccatatatacaccatatatacaccatatatatacaccatatatacaccatatatgtacaccatatatacaccatatatatacaccatatatacaccatatatataccatatatgtataccatatataccatatatatacaccatatatataccatatatatacacataccatatataccatatatatacacataccacatatatacactatatatatacacaccgtatatatacacaccatatatatacactatatatacacacgccatatatacacacaccatatatatacacaccatatatatatacaccatatatatatatacaccatatatatatatacaccatatatatatatatatatatatacacacaccatatatatatatatggtagcagcaacaggattggatatgggggaggagagagaaggagaagttcatgatgagtctgccatttctgatatgtgcagttaggtagatggtgaccacatgaatgtaggccatttgggagaggaatcaggttggaaaggaaaattttaaacatgttgagtggaaggtgcctgcaactcatccacttagggttctccagcagatggtggactgcataggtctggtttttaacagagcaccacaggctatagctagatacagacatgagagtcatttgcagagacctagggtgtgttgaaatcaccaggagagaatgtcaagtgagcggagcagagggaccatcagagaaggtgggaattccaagtagggaatgatcaatagtaataaatacaccaaaaacttccgatcaactaaagactgaaagtatttccagtggtgatatggcttcattgactccatagctagtggggtttctccagagggaggagagcagaaggcaggttatgggggatgaggagcagctaggacgtgagggagtagggaaagcatgtataggcaggtctttaaggaaccttgattgttaagagatgggagacaagatacaggtttctcattgagttgccttccctaaatcagggtttggtttcactggctaaaccagggggaccttataaaaatggtccaaggcgtaatatggctgatgcctccacatcctcctgagaaagaccttctccagaacaccctacctctcctagcctctcctttcaactaatgacatgaacgtgtttattgcccatctcttcgccagtaaaatccagggtccatgaaggcaggcatctttgctgccttgttccttctgttttctcatcattcagtaatgcctggtattatttggcatcaattcctgtcactcgctgtgtcactttatcacacaaggcttctattatgggacccacaggagaattttcgctcaggccttataccaggcatgattaggccttccctgagcagccgaattgttttcatcacacggacactatgccctgttttatgtttccctctgattatgcttttctctatgctgtggtcacagaaatggagtcaaatttccatcctatttctagcagatcatataacatccaggcatgggtttttgtgtgaattcattcaacacaccactaactttgagctttttttatcctcatcttattttccatttatctgatttcctcctttctttatatttgatgtttgtttttcttatccagagtgcagtttcccaggtttcttcaaatattttttggaaaaaactgaggttatatgtcaataatgggaaaaataggatggtaaataggacttgtgtggaactgggttttgagacaaaagaaatgaaaaagggatgaggctgactttacacgtaaagggagcaccctgaggggataggggaagtggggatgtgatccccagccctagcgggtttctaggagatttcagctttgttggagacacatcaaagacactaggaagagagtaacataacaaggccatagaagagcatgtgctgtcatgaatggttcagggggttgtataggggtaccaaagaggaagagagcatcatagcatatatgctggcatgttctagaaggctccatggaggattttgggcaacttcagcctcaaagagggaataagatctaaatagagcaagtgaaccttacatttgtcaagaaagatttgagtgtggcagtggcttttggggcaggtggccagaaatctaggtccacctttgctgggaaggaggcactagctggagtttggacggtagtgggatgttgaggtcgctttgtagatttcagtttggaagccccaaactgtgggggtgtctttgccaaggtcataacaggttggactcctctcttgcttggctgctcgacttgcccttactggccgggcttttcagacaagtgcattcattcctgcccattcagatctgctttcttcactgacctcggcagcagagaggccaggtttgattgaaatttcacttaaggtgcacagagcatcccttccttgccgaactcatcagccagcaataaatggaacttcttgacagtttcaaatttcctgccagggagcagctggtgagtgttcctctggagaagcagtcttggagaaattttatcagtatctggctagagaaagtattttctacctctcctctcctttcctctctttcatccctctcttctcaccccctctcttctcttccccttctcacccctccccttttatcattgctctcttcttcttagtcttacctgtaaagactttgcacttctttagtccttagccactgaaaattaatttagggacaagagaaggccttctctacacagccttctgagttactcattactgtctttaagattcaaagagcaaaccctcttttttcaaggcttctcttaatgagccatttcagcatcggacttccaattttcacccctgccagaaaacagccgctgggaaggtttgggaaaccagtctcccttccagagacttgtagctattgggctgcaggagcaatataattattccccattagtgctctatgaaagtgcagatggtgtacaaagtcctgatgctgttttgcttgcctttttttcacccttcctgaaacattttggtttatgtcccttcatttcagaaaacaaaggtaaggcctggctcagtgtatttgggtgaatatcagagtacagtatcataaatttcctatatggaacctataatttcttgttatttacctaggcatttgaagacacctgttagcctccagcaggaaactgtgttaatcacaactccctttgctgctacaggaagtgcctggtcccctcccaaaataataatcagtcaccttaaaacaaaggcaacagcctgaaaaataacgtggtgataactttattagtgatccccaacaaggcaaataaaacagaagtgtagatgtcatctggagaagagatttcagaccttggctaagctccaccatcccttttaccaaacctttttgttttctctccagttctcctcggctctgagtctgttggagattagaagtatttctgacatgctgtgcaaatatatgcaaattcattgtgagttgtcatcaactccactttcccccatgtggctgggctgcctgtgcagtgctgggctgctggcctcctggaatcgcagcaatatggcctatgcaccctgtgccaggagccattagcagccttgatgcatcggattagggagctctgatggctccatggtgtcagtgagtggtacccgggcttctaggctgtggaacagcacaaagcaatgtcaaaggcagagggaaagatgctgatttccactgatttttaaaatatccacttggtttcccaattttactttcatatatatgcagccacagtagaaattggctatcatgacagcagtgattatctgatgatgtccttatacatgcatatcttttagtgccggtcttttaagttgattgctgctgagattttccagaggagcacatcctgatgtgtgtgtgggcaggcgtgtggctctctgtgtataaacacgtgcagagtgtgagccacacaagggtcaacactacatttgcatattaattccaaataaccaacatgtgactcctaacatgggcatcctcaagcaacgggaaaattgtcttgattttcttgagattgttttgggtcctcccatcctttcctttaaggtttttcctatcttcactcaccctcattggcctgtttgtagggcccaatgagagaggaagagtgggttctgggtgggtgggagaatccgaaaggaaaaggtatgggtaactggaagagaattttaagaacttacgtgactaccaccaccttcaaatacaactcttcaattgagagcagaggattctttgctagattccattctgttacctctcttgcccatatatcaccatgcaaacagtaaaaaggtgaatgttggactcacataggacttttatgtaattgttataactaattaagagtcataattatttcccactttggaacaaagccctttctaacaccctacttattatgccatcacctggagtgcatatgaataaattcctgctgctactcaccctgaagctgcccaaggaagaagcagctcaaacaaatcttagcccatgcatttggagaggctgccctaatgactcactgatagttattgagaaacagattatctctgtggatgtctgaaagagaagggaatggtttcaagggctcagcagtctccagagaatatattaccaaagattcctctatgactgtgccctattaaaatgtatggaaaaacaacctggattctgggtccctgtaaaaggctccaatctgcatttatcattgaatctgcatcatcttaggcttacacttcagttatgacgacaatatggggcttgacaattctgtcatatttttgatatttaactgatgtatatttttttaatttttaaattttattatttcagtaggtttttggggaacagataatgcttgattacatgaataggttttttagtggtgctttctgagattttggtgcactcatcacccaaccagtgtacactgtacccactgtgtagtcttttataccttgctgccccccaccctttaccctgagtccccaaagcttatcattcttatgcctttgcatcctcatagcttagcttccacttatgagtgagaacatatgatgtttggttttccattcctgagccgcttcactggatggagtctccagttccattcaggttgctgcatatgccattaattcattcctttttatggacgagtagtattcatgtatttatataccacattttctttatccactcattgatgggcatttgggctggttccatttttttgcaattgtgaattgtgctgctataaacatgcgtgtgctagtatctttttcatataatgacttcttttcctctggggagatacatagtggtgggattgctggatcaaacggttgacctacttttagttctttgaggaatcttcacactgttttccatagtggttgtgctagtttacattcccacgagcaatgtgaaagtattcccttttcactgcatccccaccaatacctattattttttgattatggccattcttgcaggagcaaggtgtatcacattgtgttttgatttgcatttccctgataattagtgatgctgagcatttttccacatacttaatggccatttgtgtatcttcttttgagaattgtgtgttcatgtctttagcccactttttgatgggattgttcttttttttcttactgatttgagttctctatagattctggatattagtcctttgtcggatgtatggattgtgaagatttcccactctgtgggttgtctgttaactctgctgcttatttcttttgctgagcagaactttttagtttaattaaattccatctatttatctttgtttttgttgtatttgcttttgggttcttggtcatgaaggctttgcctaagccaatgtctagaagtgtttttcctaagttatcttttagaatctttatggtttcagggtcttagatttaagtctttgatccatcttgagtggatttttatatgaagtgagagatgaggatccagtttcattcttctacgtgtggcttgccaattatcccagcaccatttgttgaatagggtgtcttttccccactttatgtttctgtttgctttgccaaaaatcagtcggctgtaagcatttggcttgatttctgggttctgttcccttggtctaggtgcctatttttataccagttccatgctgttttggtgactatggccttatagtgtgaagttggggggtgtgatacctctagatttgtggttttttttgttgttgttgtttgttttttgcttagtcttgctttgactatgcgggctcttttttgattccatatgaattttaggattgtttttcctagttaagaatgatggtggtattttgataagaattgcattgaatttgtagactgcttttggcagaatggtcattttcacaatattgattctacccatccatgagcatgggatatgtttccgtttgtttgtgttgtctatgatttctttcagcagtgttttgtagtttttccttgtagaagactttgatgttcttgattagatatattcctaagtattgtattgtatttatttatttatttatttgcagctactgtgaaaggagttgagttcttgatttgattctcatcttggtcactgttggtgtacagcagagctactgatttgtgtacattaattttgtatcctgaaactttgctgaactcatttacaagttttaggagctttttggatgagtctttagggttttctatgtatacgatcatatcatcagcaaacagcaacagtttgacttcctcttttctgatttggatgccctttagttctttctcttgtctgattgctctggctaggacttccagtactatgctgagtagaagtggtgaaagtgggcatccttgccttgttcctgttcttagggggaatgttttcaactcttccctgttcagtataatgttggctgtgggtttgtcatagatggcttttattaccttaaggtatgtcccttctatgccgattttgctgcaggttttaatcataaagggatgctggattttgtcaaatgctttttctgtatggagatgatcacatgatatttgtttttaattctgtttatgtggtgtatcacacttattgacttatatatgttgaaacattcctgcatccctggtatgaaacctacctgatcatggtggattatctttttaatatgctgttgggtttggtttgctagtattttgttgaggatttttgcatctgtgttcatcagggatattggtctgtatttttctctttttgttatgtcctttcctgatttggtattagggtgatactggctttgtagaatgacttagggaggattccctttttcctctatcttttgaaatagtgtcaacaggattggtaccaattcttctttgaatgtctgatagaattcagctgtgattctatctagtcctggactttttttgttggcaattttttaataaccctttcagtctcactgcttgtcattgctctgttcagagattctatatcttcctagttaaatctaggagggttgtatacttctagaaatttatccatctcctctaggtcttctagtttatgtgcataaatgtgttcatagtagccttgaataatcttctgtatttctgtggtatcagttgtaatatctcttgttttatttctaattgagcttatttggatcttctctcttcctttcttggctattcttgctaatggtctattaattttacttatctttttaaagaaccaagtttttgtttcatttatcttttgtgtttttttttttttttttttggtttcagtttcatttagttctactctgatctttgttatttcttttcttctgctgggtttgggtttggattgttcttgtttctccagttctgtgaggtgtgacttagattgtctatttgtgctctttcagactttttgatgtaggcatttaatgctatgaactttcctctagcatggtttttgctgtattccagaggttttgtcattattattgttcagttcaaagaatttttaactttccatcttgatttcattgttgacccaatgagcattcaggagcaggttatttaatttccatgtatttgcatgcttttgagagttccttttagagctgattttcaattttatttcactgtggtctgagagagtacttgatataattttgattttttaaaatttagtgagacttgttttgtgggctatcgtatggtctatcttgtagaatgttccatgtgctaatgaatagaatatatattctgcagttgttgggtggaatgttctgtaaacatctgttaagtccatttgttgtaggttatagacttaagtccattgtttaagtccattgtttctttgttgactttctgtcttgatgacctgtctagtaaagtcccttactgttattgtgttgctatctatctcatttcttaggtccagtagtaattgttttataaatttgggatcaccagtgttaggtgcatatgtatttagaattgtgatattttcctgttggattagtccttttaccactatataatgtccctctttgtctttttaaactcctgttgctttaaagtttgtttggcctaatataaggatcactactcctgctcacttttggtgtccatttgcatggagtatctttttccacacctttaccttaagttgatgtgagtacttatgtgttagatgaatctcctgaagacagcagaaacttgcttggtgaattcttattcattctgccatcttgtatcttttaagtggagcatttaggccatttacattcaatgttaatattgagatgtgaggtactattctattcatcgtgctatttgttgcctgaataccttattttttcattgtgttattgttatataggtcctgtgagaattatgctttaagaaggttctattttgatgtattttgaggatatgcttcaagatttagagctccttttagcagttcttgtagtgttggcttggtagtggcaaattctctcagcgtttgtttgtttggaaaagactggatctttccttcatttaggaagcttagttttgatggatacaaaacttagctgataattgttttgttttggaggctaaaaataggaccccaatcgcttctagcttgtggggctgagaaatctgctgttaatctgatagattttcctttataggttacctgatgcttttgcctcacagctcttaagattctttttcttgtcttgactttagataacctgatgactatgtatgtaggcgatgatctctttgcaatgaatttcccaagtgttctttgggcgtcttatatttggatatctggatctctagcaaggctggggaagtttttctcaattattccctcaaatatgttttccgaacttttagatttctcttcttctttgggaacaccaattattcttaggtttggacatttaacatagtcccaaacttcttggaggctttgttcattttaaaaaattctttctttgtctttgatgcattgggttaattcaaaagccttgtcttcgagctctgaagttctttcttctgcgtgttcagttctgctgctgagattttctagtgcattttttatttctctaagtgtgtccttgatttccagaagttgtgattgttttttatttatgatctctgtttcactgaagaatttttctttcacatcctgtatcatgtttttgatttatttaagttgtacttcatccttctctggtgcctccttgattagattaatacttgactttctgaattattcttctggcaaatcagagattttgtcttggtttggatccattgctggtgagctggtttgatcttttgggggtgttaaagaaggttgttttgtcatattaccagaattgtttttctggttccttcttttttgggtagcctatatcagaaggaagatcttggattcaagggctgctgttcagattcttttgtcccaaggagtgctattttgatgtggtgttctcccccttcctctaggaatggggcttcctgagagctgaactctagtgattacttttgctcttctgggtctagccacctagtagagctactgggctcctggctggtactggggaatgtcagcaaagagtcctgtgatatgacccgtcttcagatcttccagtcgtggataccagcacctgctttgatggaggtagcaggggaatgaagtggactctgtgtgagtccttggttgttttatttagtgcactggttttgtgttggttggcctccagccaggaggtggcacttttaagagttcatcaactgcagttctatagggaggatgcaaactcgccctaggaacaggtttctcaggtggtgggcagggccatagaactcccaagagattatgacctttgtctttggctaccagagttggtagagaaagaccaccagctgggggaacggataggcatttctgagcttagcccctcccagggcagggctttctgtggctgctgtgggggatgggggtgtggttcccattccagtggagttatactcccaggcagattatggctgcctctgctgagtcatacaggtcaccaaggaactgggggaaagctagctgtcataggcctcaccctgctccaagcagcctgtagtcctaatggcctcattccctccatgctcccccaacagcactgagtctatttccaggcagctgatgaccagggctgagaacttgcaccagaccatgagcttccctattgagaaagcaagttgactcagtttttggcatctcagggagcctgcaggggtaatccagtttcttcaaagcatctgtggattctctcagctttcctggtatgttcctgcagtcgtttttggagcaaatgttcacattgtgagtctccacatgctactctgtctgtccaagcaggagctgcaagctagtctttcttcctatcatatctatgattctttagcaattgaaagtctaaagccatcattcatctcctcttgccatgatatctaaatataaatatgtatttcacatgtctcctaactggcaagagatgcccctcagtggaattttagtttccatcacctgtgaaagaaggagcaagccactgccaaaaggtggtcactcagcctcttgggccccagttctagaagctctggatagtgactgcctgtcgttggggtgctcaaaatctctttgtgcttgaagttctcagagagaacatatatcctagctagttctgagctgctcttcctgtggacacccttcaatcacctcttcagggaagagcctgtctctcccaactgtcccacagagagactttcctcagactgacttatgattctctcacacttctcgattttagctcctactagtggcattttgtgtggcatattttgtgtttgcacataaaatagaattcaagcaaagacttgaaagaattaataaccatctggtgactctctgtcacacccataaaatcctagtataatttaaaaatatatatagtttttgaattcatttgttgaaatatttaaataatgttttcttggtataaaagaacaacaatggggtgcctaaaaatgctccaaagtgaattgtgtacacgacctattctatatttggagttagatttcttcagcacatctttccacatttgttggaaatctgttcacagttggtggaaatctgtccagctgctttcatgtgatatgctaataaataggcatgtgccttagtctgtcttctgttgcctataacaaaatacctaaaactggataattaagaaagaaaaggaattcatttcttacagttatggaggctgagaaattcaaggtagaggggctgcatctggtgagcaccttcttgttagtagggactctgctgagttctgcagtaggacagggcatcacaatggtgagaggccgagtctgctagcttagttctctcttcatcttctttttttcttaattaaaaaaattattaatacataatatgtgtacatacttatggggtacatgtgatattttgttgcatgcatagaatgtgtagtgatcaagtcaggatatttagggtgcccaccacctggggaagttatcacttctatgtattgcaaacatttcaaattctctcttctagctatttaaaaatatacaacacattgttaactgtattcaccctactctactttccaccgttagaacttagtccacctatctaactctatgtttgtactcattaaccaacctcttttatcccctttacccaccccacacacccttcccagctcctggtatctatcattctactctctacattcataggattcaccttgatagctcctgcaaatgagtgggattatgtaatatttgtctttctgtgcctgacttatttcacttagtataatgaactccagttctatccatgttgctgaaaattacattatctcattctttttatggccatatagtaatccattgtgtatatatgtcacatttttaaaaatccattcatccattggtggacacttaggctaattccgtatcttggctatcgcgaattgcgctgcaataaacatgggggtcaagtatatttttgatacaccaacttctgttcctttggataaataccaaggagtgggattgatggatcatatggtagttctaattttagttttttgagaaatctccatactgtattctacaatggttgtactaatttacattcctagcaacagtgtatcagctcccttttctctgtatccttgccaactctgttattttttgtctttttaataatagccattttaactagagtaagatgatatcttattgtggtcttgattttcatttccctgatgattagtaatgctgagcatttttttttcatatacttatcagccatttctatgttttctttggagaaatgtctatgcatgtcctttgccccctttttaatggggttgtttgttcctttgctgttgagttgtttgagttctttttatattctgaatattagtcccttgttagatgaacagttggcaaatattattttttccattcaacaggttgtctcttcactctgttgtttcctttgctgtgcaggacctttttaatctaatatgctcctatttgtctatttttatttttgttgcctgtgatcttgaggtcttagccattgtattagtccattctcatgctgctatgaagaaatacccaagactgggtaattgataaagaaaagaggtttaattgactcaccattctgcatagctggggaggcctcaggaaatgtacaatcatggcagaaggcacctcttcacagggcagcaggagagagaatgagtgttcagcgaagggggaaggcccttataaaaccatcagatcttgtgagaattcactcactatcacaagaacagcatggaggtaaccactcccattatctaattacctcccaccagatccctcccatgacatgcgaggattaggggaactacaattcaagatgagacttgggtagggacacagccaaaccatatcagccctaaattatttgcccagaccaatgtcctaaagtgtttctcctatttttttttttctagcaggagaaaaatccctaaatactgcttattctataacccaaagataaccacttgatagtttcaggtcttgcatttaagcctttaatctatcttgagttgatttttttctcttctgataaagccaccagtcccacttccatgataactcattaattcatgaatccacaaatggattaatccatttatgagggcagagccgttatgatccaatcacctcttaaggccccacctctcaatactatcacattgggaattcaatttcaacatgaattttggaggggacaacattcaaaccatagcagcatataattaggaaataattttatttatatatagacatgagatataatgaataaggaataataccaggtagtgctcagtgaaatataaaaaggtggggcaaactatagtattctatatttggtaaagccttaaaagagatagaagaagtcttaaaaataagtaggtaagcccctgtcctgctacgtggtggggcataggtttcattagtgatgggtaacatttatgagtgcttactgacatcagtactgctctgagcatttcacttgtgttttcttccttgttttaagtatacttactaaagattgaaaaggataagaatttgccccattaggtagcacagctaaaaagtcccaagactagggtttgaacctcaggagtctacattgcaattctgatcactacctggggttaggtcaaatttcacaggttaaaggcatggtcccccacaaaactgacctcatcccagatatcagctgcaagctcaagaaggtcacagaccgcccatacctctgacaaactgaatttgagtgttcccatgacctcctcagctttggcaattcactagaacaactcagagaacttaggaaagcactatacttattattacagtttttactgtgagtgatgcaaatcaggaccagacaaaagaagagaagcacagggcagaggagagtcccaaacatggttatctttggaacgtgtcgccctcccagcacaattaacaaagaatctccagtgagcttcagtgttcacagtctttattgtgatttcattatgtaggcatggttggttgaatcgttggccatgtgactgaattcaatctctagccccaaaatccttctctgataacatatggttcaaagccccaaccctatagtcacatggctggtctttccagcagggcaggccccaatctataaactctctagggacttacctgagtcacctcattagcataaactcagatgcggtctgagggtccacttggaataatgaagacactcctactacttgggaaattccaagggtttaaaggctccctcccaggagccagggacaaaggccacacaaattctctattatacaacacagtcatcctggtggtaagggaacttgagtctcatcaaaggacttcagaagactctcaacccccttctctcctgaggcccaacattaaacactaagctccacagtaaggctcctgaaggaacatagacttctgtttctgaggtcgtgcctgagctctagctgggtgggttagtagaagggctgccctccgagaattggagactaaatgctcagggtcctcagaagtttcctaacaagagggtgcagatttgctctgcaaagactggaagccacatatttggacagcaaacacctccatgcattgaaatgactaacaagccagaggagcctttcctagaggtggaggacagcatcttgttaagtgtactaaaaaccatatctgtaaatcagctgccgtttaaagcagttagcagtcacttaccaccatgggcaataagcatatgctgggctacacctgccatcagccccagggagcctcagagaggttcctggttcaccatttcacagacagagacattggtgaaggagtatgggtcacagatggcctgggactgagaaatgtctgctccaaccttatgttcccagttgtccaccagtccatacctgttggactaggagactcagaacttctagggtacagaactctgggtgcttggagtactcattaaatttgcaagctctttggtctcccagaagaaggaagcagatacaagggatggggccccatggaaatccagagaggccaggctgtgctgaagggagacgggcatcagaaactgctggggtgggtccaagagctgggaaaccagagaaaagtgtttctggaagctttactaatcattccttctccccagcatgacttattccctctcacctgcaggccttagcctgacagatcagtatgcaatcagtctctcactctacctatagggagtggatagtaaccagctcaatgtatgttgcctgggttttagggaaacaaacacatttctgattgttcaaaataatatatgagcattagagagaaaatagagagatgcacagagcaggacaaaatctctaaatactgcttattctataacccaaggataaccacttgataaatttgatatttctccatctgagtccaatgctaacctaatctcaaatatcatatacacactcacacacacagacactcactcgcacatgtccctcactctccggttgctccttgtctgaacttaggagctatgaatacattcagacatagagacatacttataagtagtatttgaataactacattttcattcctcaaaaaatttttaaaacaaaacttggatagttgtgaccttgtgtaaattccttaactgctctgactttcaggttactcatctgtgagtaggtataatgacccctgcctcacagaactggctattagaaggtctcaaagagacaaaagccctgaggcactggcattgtgcatgtggtgcagcagggacccaggcaccattagttctccctctctcactggatcctctctggctccaataggtcatcccagccccaccttgactcacctgtctgcaagcatctgctcatggtcctgaagcacctagatggataattcatgggcaaagctcagagaggagaggactgtgtatggctggtaggagaggggctcttggaagccatttgccatgggtgcagatggcataaaggaggggaggagagaggcatttcccaagcagtaactttaatattttcaaatccatatatctctaactatgactgagaggctcaatggagccattggcatggatcaaatgaatgagctagtggttgagatggttggtcataacatttgtaagcatagtcctgacaggctacttgaattttgactccctgcaagttaagcactgggatggtttttgtgaagcgggttcactgggcactggttacctacttgtctgtgtccagtgagacaaaacactcacatacaagacatgaagtgagcttattgtttgcaggcaggcagcaagagaccacagaagcctaggatgtaatttgagccagtctccccaggctcgggaaagctgtctggggctgctagtctcatctactcatgccccacctgtaccacagctgagggaccccagaaagcagcctgccctcagttttatactttggggctcttggaatcactgggataaagtgttgaaggacatactgtttttcagggttgagggcaggctgaaacagagcctggactattccagccagttcctccctatttaaggttgttgcaatcttagcacagtttccaagtgttcttgagaatcacaactgagaaagagggagaactgggttggtctaaggccacccagagaatagtcctgaaattttgactgctgtatggagttcagctctttttgttcatggttctattttgtttactttactgccataatagatctgataaaatggataaggaacattgatgttataatatacaaaatgaatgaggagtgtaattgtgatgacagttcttcaaacatgcctcaagatgatctttacctgattgtatgttgcatttatttgcttactatctgtacgtagtatataaggatagctcctgaactcccaaaggcagtgttaaaaagagaaaatagaatgatgattataaccaatctgaattttcgtttattcagattaaagggtttctttatccaaaatgtattatttgcagacataccaaaaaggaaaacaaaaaagcctaaagcataaaccttttctatctcatttaaaaggaaaaacacacaaaatataaaagttaatgagtttccttttaaagtgaacattgcaagaattcccagcatcccatcgtgaagcaaggtttgcctgtttctgatgcaccatcatttagttaaacttcaatctgcattttcatatagattcagtctccaaaccaaacctgatattttataacactttggaatttattgccaacaaatcaagtttttctaacataattaatctaaagtaaattaaactgtgtgcttcacttggcaaatggaaataagtaaaaatctgactacatattatgaatattattaaatacaattaaaaataaaatttataatacattcttcaatactacactaatttgaatgaaatatgttaagcttgaaatcagttctgtatgatattctaaacaaaaatgacaaaatggtttttaaaattccaaaggcagttggtaagatcgtatgttagtgtgagtagggttcacaaatcaaaaaatgtagtgctgagggagaactctgactctttggacaagcttgtggtgtggctaatcagagaagtgtcatatttgctgcggaaggtgattttttctaaagtagccaggtgagggtgcaggaccatttgctgtcttggtaaataacagcaaacactgacttaatatgtactacgtgccaggcattattgattaagcatttattggtgttagctatttaactctaccaaccactctgtgaggcaggcattgttgctaatgtcatccccattttacagatgaggaaactgagagccaaagtccaagcaaagtgatgactcaagtccaggcagactctatacattgaaccactgtgctacgtgcgtatcgaaaagtgcacgaactcatggttgacttctcataatacttgggtttgtcattgttcctcaccctcacccccagtccccaatccccagacaaacaccttgtcattgtcaggtgaaagaagctgatcctgtgttcacctgggggctccctttttcctcttccaagggtgttaggctgtaccttggctctctgtcagtctagggctaagagtataacttggggtaattatgcatttcttcattcttgcctctatgctggtgtacatgtaaacttggtaggagctgctgaactgtaagtaaacctaaggcgtatggattattagggaggtattgaagcatttgctggaagaataggcccagttaaccagagttggctcagcacacctccccaggtcagtcatggggaaagtttaagggattctgaaagagatactcacggagagatgagggcactgaaaaggataagggggggtacagcccccttctccctggcaccctaatggcctccaaacactcatagtcctctccacaagggtgtgttctgggtgtgcttggtggttatggtttgtccttgtggaaccacctcaggcagatcagaggttggggattccagtttcagaatcaggttggaatcctccctctactctttatcagctatgtgacctcaggagagttacctcatctccctgagcctctgtgatctcatctgtactagggacttaacaatagttttcacctaatggagttgttgtgaagattgaataagaataaagtacacactagtgcctggctcagagtaattacacagagcgcagtcatacatttatgcatactgcatttagaagcttgctgtcactcccaatacatagatacttttacagtacacacatgtattcatgcatatttcaagtatttcttattttttatccctctggatggctgggaaacttagactttccaattaatattttcattctttattgctgcataacaactaccccaaaacattgtggcttaaagcacccattattttgttatctttcatgattctgcgggttgactgggcttagctgggcagtccttctgtgcccatatgaagtcagcttgggctgcaatcacctggggatttagctgggctcctgggtcggttctgttcaagatggctcaatcacacggctgcactacatgtggtctccgtgtgacacatggttgggttccagtaagatgtgtcccaggagtgaccattccaaaagtcccaggcagaagttgcaagacttcttatggcctagccccagaagtaggacagcaacatttccacagcattgctcaagaaaaccactaaagccagtgcagaatcaacagtctgcaccccgtctctactaaaatacaaaaaattagccgggcgaggtggcgggcgcctgtagtcccagctactcaggaggctgaagcgggaggatggcgtgaacctgggaggcggagtttgcagtgagctgagatcgcgccactgcactccagcctgggtgacagagcaagactctgtctcaaaaaaaaagagtctgtgtattccaccgctagatatctggagtagcaggtgtgtccagggaaggaattaatggcggcagcttgggaagtctgtctactatgtacactacactgacaaatgcaaaagcgcacatatactgttttgttattttcgctttctctcttctccctggatggttgggaaactaagtcttgtcaattaacatctttgtctgttccagcttaagagtatcttttcagttcgaatattaaaactgaatttctttttttagatggggtcactctggccccccgagtgggagtgcagtggtgcattcacagctcatggcagccttgacatcctgagggttaaggtgatccttccacctcagcctcctgagtagctgggactataggcgtgcgccaccatgcccagctaatattttgtattttttgtaggggtgggtttttgccatattgcctaggctagtgaatattcaatttaaactaagttaaattatctaatagagctggtttgagtagcttcttttggataacttgcagtccaccttccttcttttcttttcaagatggcctctggggatgccctgatgtcctgtggcagcaggagggtgggtgatacggggatgggggttggcctgctctcccacttttccagtaaagaaaggctgggccagatctgtgactgttaaggcagcactggtccatctggccttaggggatgcagtgggacccaattctggaatccctagcccaggccacttggttttgatcttgacatctccaccgatacagacctttgtcctgtctctccatgtacccctactgtggcatgtcagagctcctgggtctgtgttctacctgtccttccccactgcctgccactgtacaccctcaccattgctcccacaccaagttggaccccttggccggagttatccaaggatatctggagcaagggatggtctggagggtcacaggctcccccgtgttaagctgaatttatctacatctttcccacctcacccctccttgaggtgtggctcccagatcattggtacctgcctgatttcttctctctagctctgttcccctctgccacttacagtccccagcccattggaacagtagtcaggctttgcaggctccttgcaggatgtgcctctgccctgcaacagctctgcttagagcctagcaggcacaggtggaaggtgcatcctctctacaccgtggaagagataatgattacatcctctggacttggccctagatatattaaataaatgccagagaaatttagaaaactttcttggcaatgtctagcagtcaagattcatgtctcttaaaaaaactttttaaaaagcctattttggtaacaaattgaacaatccttttttctctctgagttcttgttttaacaatcttaatactctagccctattaccaataacctctcccatggtcaccctaccagccagagtatctgccactggctgacatggaagacaattatttcgaggaaatgcacagtgaaaaaaacacagtaatatatttccaacaaaacaaaacaaacctcaagttccctaactagtagctacaattgtgatgaccattgtccccacccagatcattcatttattggtggcaggggccagttctggttactttgacgttaacctgccatgtgacttcagcaagtcaccagcagtaggtggcgttctgccaaggtttccaccacatctctaaggccccttccagcctaagtctccttctagtgacaacctgtggacagtgggtgagaaaatgcaagctgctgaccagctgacactgagcagatctcttagttattgactgaccatttatccaaccaaggtttccaaggactgggacattgtctttttcaccactgtatcccctgcagctaaaacagggcctggagaatggtatacattcaataaataaatatttattagatattgagtgactgctgactccttcccactggtcctccccagacacctgtcccacgtgtgatgtttatcaggtatcagaatgcaatatccccaaatatggtaccttggcatactgaatattttaaggtgaaggaaattgagaagatcacagaagcaataaggtcactctgatcttcttcctgcttcttctctcctgaagtgggtcatagagactagaattcccctcaccctttcttccttaaagcaactaataaaacctaagaatgtcactctctgaccttgtccctcctttctccctgaagactctcatacaacaggtatcctgctatatacctagagggaaggaatgtcacacagaagccaagaagaatcagactaaacagggcttgctaagttcctccctgtttattattattaagtcataaccttttgtcctctgattgtatttctgcatgactgtccgtaaaaatacatggttttccctaggtctttgggtcttcatttctgaagcctcccatgtcatgtaaaatttatatgaagtaaatttgtattattttctcctgttaatctgtctcctgttatcggagtcccagccatcagccttgcagtgactgacggaaagatcttactttttctcctctgtcctttgtttctgctttctgggtcctggcaagcccgtgaaggctgatgtctgtgcccacctcttgctcgccaggcttttgagggagggaaattctcagcgtccttggccattctttactggctttcatagtgagatgtgtacctcgtcagagctgagggggtgcctctgaggaaggtggcatgttctctggctaattcagagcttctcatcagacaacgggtctctaggaatgaggagcagaccctgctcagacattgggagcagcaagattcctagaatgagatggaatggtccacaatatggaatatgcactctaggctgatggttcacctcaggaggtggccttgggtgttcaatacaggacagggaagtgccaaaaatgatagagggtgtcttgggggatgggatgcagatagctgacatttcctattcttaatatctctcagcataaagcaaagaacatacaatgtcagtgggggctcacctgaggcctgttagttcagaagttctctgcatttttcagccggccacactctgataaccttcaggaaaggtattctcacatttgtacctacagttacctcctaggtaaagccaagctgggtcatgggttatttgctccctgcttacagctggaacgctcttccttcttccactggcctgtgatgggccaacatgacagaaccttaacactcattgggatacctagtgcagcacctagcacaggtgggcatttggggaatgtttgtggaatgaatgaatgaaacaaagggcaagagggaggatgaatgagagggaggaagagaagtaaaggaaagagaaaggaatggagaagaaagattatttcatattggtgataccagtgctcatttagaagtctctaaatttttgtaatagcaaaagattaaaaataacaccgatgtccatctatagggtcctggctaattaactaactgtataataagataaaatgcgcatttttttttaaaagcggacactcttcaggttttggtatgaagaagttttcaaggtactaaatgtaaaaagcaaagtcactccgtttgtgtgtttaggggtgtgtgtgtttgtgtgtgtattaggctacttctgtgtcaaaaaagagaggaaaaataagaatattttatatatttacatgggtcatataaacaaactatgaaagagtatacaggaccctaataaaaatagttgccattttgggggaggttagttgggggaaggaaaggaggaagaaacaggaggaaaacttttcactagctctttaaaatggttgtgcctggaaatatattactcttgccaaggttgtagtttaagtccctcaagtcaggggagcattctagttgaatttcctctatctagtgccctgtgaagcatgtgactagagctctcccttgatcatggcaaaattgatttgataatagaatctgatctttttcattttagccaaatctagctcatctgaaccattgccctccagttataagggaggaaagagagaatgactcagctcaaaggaactgcttagatatggttacagcatgctacttctcatggtaaattatgttattgatcgccaaatttgtgaacagtttttacctatacaaagtattcagttttataagtaaatgtttttaaccattgaaagaattggtaaaattcaggaatggttacctcttgccaggattcttggaaagatggaaaatcggaaacaagcatctgtttcactgctttttctacatttatgtctttatctttgaacaagtacctactgaacacctattatgggtgaagcttagataaagaaagtcagaaacatatgtgggtatattgaaaccattgacattcccataggggctttttttccttttttgctatgtttggggggaatggttaattatcattgcactataaatgtattggcataacaagtggcttatattcttcactttaataacaatctgtaatttcctgagtcataataataaggctttaacatattagctcagtgaagacttggtcaatgtctttactgagaaaaatatgttatgacctagcacatgataccatccattataatgttcttggtcaataatcataattttattataattattgaaagctagggtttcccctctgtgcagagtgttgtaaagacagatgcatgagattgtgaaggatcaaggtgttatccataatagtacattcagctggatttatgtccctctccaattagaggacaatcaagctcaaattaatttagctcacagctactaatgagcaacagcaaaatcagctcactataaaaaaattgttattgaattttattttctccaacttgatgaatgtctatgcactgcgagtaatgtgtgtttgaggtctggtggtgagggaccttgagggttgtctcatccgccccgttcatgggctctgtgacagctccgttccctggtgcaacaacatttaatgagttgttagaggtccacagagatgggcttcctctgttaactgagccttgacagtgcttttgagtgaattttctggtctaaactgctgatataaatataatgcaaaccacatacataatataaagttttctagtagccacattttaaaaagtgaaaaagaaataggtgacattaactttaatatattttatttaactcaatgcaatgtatccaaactattatttcaatgtgtaaacaatataaaaatattaatgcaatagttttcattctttctgttttgtagtaagtcttcaaaatccagcgtgtattttacatttatggtacatctccagtactctagcctcctttcaaatgaacaatagccacaaggggctggtggcttccacatggcacaggatgggtctagattgaatttcttcattcataacaaagctgcatttccctctttggagtttgtaggttgaggcaaggtgagcacaggctttggttgctcaatgatgataaagaacatacacaacctataagcaggagaagatactacattttcatctttactgtgagtcttgcaagtcattggcaaatttacagtctctgtgaattggcttatggtccctgtcaccatccacctcccacactaataaaggcagaatagatcctcataaatatcctttttccccattatcagagcttcaccaattgtggcctcataaaaaaagaaggttgtttattattattattatttgttgacataaaaaatgcatatttttctgaagcctgacttcccactagtactgttgctttgacatcaaatagggcatgaagcatattgtcaaatacatgtttggggaattagaagccattgagtgtttcatctctttggcaatgttcctgaggaaagtgcatatttaaatctaggagaatattttaattgtttaatattgtaaatgtttaataggaattctgaggcgtaatgcaaggactcactgaacttgattactgcaaagtaggagatgtgtaatgagagtctggagctcggggttctcatcacttggagacccttatacactaatgaaatgggatgcccaggataggggcatgggggagtacatgaggaagaacagccgctgatattaccactccaatggatgcagctacaaactaggcttcttgccagcacacaaggccctctgatgacactctgataagcttcagcctggcacaatctcatcattgctatttccaccctctttcctctcaaagtaaataggtagctatcagattcctgactggtctttctgtttccagccctgtcctcctcaagttcatcctctacccagctgtcagagagctctgtctaaaatgcaaatgggaccccatcactcactgctaaaagcacttcggtagctccccattgcccttggattagagaccatgcatttcttaacagtagcctacaagctgtcctgtgatctggcttctctggatttccttctcttcccttcctctcttctttcctttttctgacttataatttatattcttacaactccgacccacattcctgtaatcattcctttcctcccctcttttggcttcttccccaccaaattttaatttactttctttataagtcataagtcagcctttacctcctccaggaagcttcccccactccactccaagcaaggcaaatgcctttgatactgctgtggtacttgcatcaaatatatgcacatcaatcataatgcctatttgtgtaaccatctgccatctgcataacaccttgcctttcatttttgaatccttcatgccaagctcagtgcctgatgcttagtaggtactcagtagatgtctgctggtggactggccagacccatgatgcagtggtttctggggtttggggaactgcctttcctctctgttggaagatgaggcatcacctctcattcagctcctgagatcagcctgggcactcattcccctacaagagggaactgatgatgagactaagtcttcagcccaatgcctgcagtagggtcctcagaggcctcactgcctgccaggcatggtgatgaaagtgtattgctttggttcagttagatgaggtcttgggaccccaccagcaatgcagtgttttgaagggagtgggtagagggaggatgcctgaacagtcaggagtttaatgtccatcttgatggtgatgagagtcattgaagcatttttagcagagagtgggagaatcaggtttacctggaccaaggctcttccagcccagcctcaactgcacgtttctgtattcctgcagtttataagggaagaaatgcagaggaaggggtcagagagagggatctgtgtcagttagaattgcaatctgttgtaagtagaagaaaattcaaagaacactgagttaaaaacaagattgggggttatttctttcccatctaacaagaagcctggaaatgggctgttcagggccagcacagtgtttacccctttgcctcattgtcttagcacacgggcttcgtcctcatggtcacaggatgacttcgcctttccaatgggaacaagggagaaggatgaagggtccaaggcaaaaggacaagctactgaatctatttcctggacagccacccagtggcctctgcttgtgcctcggtcacgtgggcactgctagctgtaaaggagcctgagagacgttgccccaacaaacttgaagttctgtgaatagcgaaagaacaaatagatactgggcgggcaactggcattaacaccctgactttccaacatcttcctgagagtttgaatttatttttttcctggcattaacactctttgaatttaccttgtttactagtttgttggcttgtggtgtctgaccctagaacatatgctctgtgagaggaggagcctcttttctctgattctgtcctgcctgtttcacctctgactcacaccacagggatgggggatcccgcagctccaggccttcagatccagaatgaaaatcctcggctccatcccccagagggatatttggaagcatctctcaaagaggtaaggtatctctggtatttggcatacaaccaatttcaccagactggctgcctctcctccatctccgggatcttgttctttttcttttcccccccttattaaacaaattagccaagatgacactggatactgattagcaatttgtatagcaataaaagaaaactggcagaattccattgttttgctctccaattcttcatttccatttttaatgtactgtgtcttcattcatttgattgggtttccttttctgtgtatgtccttaatggaacaaagtgttcttcttcccccaacccctccaataattgtgaacattaaagagctgcttaaattgttcagtcatttcattttataatttgagttgggagtatttatggcttttcctccccttccctttgtgctaaatcaatagttgctgtgtaaatgcgacttaaactgtagcatggaggcaagctcttctacttctagatccttccctgtggccccgccggctgggggatttggagtccctatctgtcaaaggccatccttagccttccggtcagccccacgttgtgatataaatgatcagcacacacatccccttcttgaggggagatgccctctctgggctcctatgttaacctacttgtgctttcaaactcataatttttcctctaaaatgatcgctcatttatttgtctactggagattctggagggaagggactttatcctatccatctctgcctccctacagcccccttgagagaatgctagacatcaatagatgcaggatttcacttaatcatcaattaatgactgattgggaagaactgaacaataacaaaagccaaaagccaaatgtattctctgtgataggcattgttctttgttgctttaaagacgttaacacatttaatctttacaattaccgtttatgaagcagggattattatcctgatttcatggaggagggaagtaagccaggaagagagattgagtagctgctttagggttacaagcccaatatgggggacagcaagattgggcccataatttggccctgggtagtgtgagcatggagcctacctgcttagcccttgcagagcacagccttcttgtctgagtagaagctgccatgtatttatatgacatctgggccaggaagcagagcctccttccctctctctgactcaggagcctccatgtggggaaaccattccaaccctgttgactccagcaaccttctgagaatagatataaatgcaaatagcaggaactgcattgatgtggaccttccttaatgcctgaaaactgcctggaagctgccacaacagtgtatgcctccccttggcatgtgcatgtggctactggaagccctgggggacgaggcccaccccatacagggcagagccctctgaagagcctgctgcaggtggctctgccaccaccaacttacgtaacaaatcactccgagccatctttactctgtaaaatgcaaatgtctgtaggtgctggaggcagcctgccaagaattcctgtggccaggaatttcacaaaccagacattacttttttaaaagagaaaagactgaagttaggtattcacctgttaaacattaagaactaagaacattaaaaaaggagaaaagtaaaataaaaaagaccatcttttgtcaccatcgtttcataaaagcattttaactccctaaaatataagtgggactatctcagaaaacaatgaacaatccattaaattgaattctgatggttaacagatgaaaaactcacactgtccttgttttgttcatccgttcagcttagacctgtgaaaattctattgcccatcattgaggtccagtttttgggaaaaagtaatgtagaaaaaaaaaaggagtccaatcctagccctgccatccactgcttgtgtgactttgggcaatttagttagcatctttgatctttggtttcttcctctgtgaattgggagctgcctttcagtgctttttaaagattaaacaaggatatgagggtgatgtggctgcaacatctgtcaccccactgattgccagggttgatttggctgatctggctggctagacgggtgtccctttcctccctctgctccatgtgcatccctcctgaagctgcatgctccgctgaagaggatgaccttccccaacagaggagaaatggtctttggtcaagggtatatgagtagccgtgctcccctgctagaacctccacaaacaagctctcaagattaaatgaggcgtgtgtggagtgctcagaacctgggggaagagtttggactatgctcagaattttcagagcagcaattctcaaaatgtgatcccagacaggcagtatcagcatcacccaggaacttttgagaaatgcaaattattgggcctcaccccagacctgctgaatcagaaactgggagtggagcccaggaatctgtattttaaccagcactcttgttgattctgatgcatgctcaagtttgagaaccaccattatagggaaagctgtcacctcagtcacagtggccactgctgtggccatgtgtgggatctgtgagatctgatagagcagccagaacacctgtgaagagggaacgaagagggtcttgagtttccctggtaattattcagttcaatctgcactttgttcacaatccatccttcatgggaggaggctttacctggacatgttaagcatgggtcacccacctacctgtcagcattagattcctcatccataagctcaggacacctgtgccctccttcccacctagcagtggtggtgacattgctctgcagagagtgagggctcccttcctcccatctagctgtctctgatgtcaagattgccaggagtggggacaagcaacaacctgcactttgccattgatcagcttttctctgtgtctctcattttctctattgagtgacacttggaggtgggcctagtgtctgcccaagtctgctgctacatgatgctgtcagcatctttgtcccaaaatacggctataattgggtctctcccaaacaaaacagtccctttacaagatacccagagaataaatccaaagtctatcctgaaacaccacagcctccaaaatctagtacccactgtctgaattttttaaaaaataaattttaaagatgtaggaagcacagagaatagtattattacatgtactcagaagtcacactatcacatgttactgtgttgtcacatttattttattattttctagtgaagttattacaagtacagtcttctttcccctccttgaattcacgcttcagtcattttcctctgcgaatcgctttatacagcccatactcaagcctgacaggaccatgggaatttccagtggaaactggtgccatattgcctccctacatttgtctgtgtgggacccctgactagaatgtccccctacccatcagctgcccctggaatttgagagttcactcaaatcctactagctcttcaagcaccagttgaaatgccacacctcccatgaagcccgtgggttttctttcccacttctcttaaactcccccagccctccccactgtcaccttgagctgggataactttcaaatccctgcctttggagcacaggattgattcagagcacgaggctgaaggctcagcttggccattgactgagtgtgggatgcttgacagactcaatgccctcatctgtgaaatggggataataatgtcttctttgcaggcttgagagaaaatgtgtgacggctgtaagggatgatcatgcgagggattttataagtaatcctaggtaagggatcatttatgtttgctaatgctccctgactttcgtcatcatttgcggtgatgcatgcacgtatctcaactgcctgaggacagagtgaatcccggcctgatttaccttttatgctacgcagaattcagtttgatgctttcccacaatcatgactcaataaggttgactgaggagtgggtagggttacgaacactgtgatcgtttctgcctgtcttactacaaggtggaggaatgggacttccctttggccgtcagacatacagcaagtgctcactgtgtgccaggcacaggactagctggcagtggaggcacaaatatgttccagacatgatctccaaggccagttataggcaaaggtcacgtgtgtgacaaggaagacatgtcccttcatgttgtttattcattgcctgagcagcagctagatggggagagctgctggggcccaaaaaagggggtgggggagcattccctgagtgcctgagataaatgctccatgaaagtggacacggaacatctcacaagtgtcttggaagcaacctccttcgtgacatcatgacaaatggcttttctaggaaaacagaccaaatgtgagcaaaaaggtctgtgatcccagaccccaaaagttctgaaaatgggatatttactataacttacttggtggcaaaacctggaccaacctgatatgaggctatttatggtattcatcctcctgagtgtgaaaatccatgcctttgctgcagaaatatgtgtgtgtaatgacaggacacttccccagaccttattggagatgtttttagcatgcggtagatgcactgtatcaccttactaaaatctgggaaattttgaattcctacagatatttgaccccaaaagttttagccataaggattgcagacctgtagaagctgcagcagtgagggactgccttccagtcaatcctgcctcccactaagtttttcttcctgtaggctcccaggcaaatggttttcttctacctggggaaggccagtcccagtatcttcaaagtgcaggcagggctcagctcaacctgcagccaaaccctagtgggatcttttacttaattcagaagtatgtttttcttaatgtgagaaacacagctcagcatgagcttacaggaaaggtgggcttagtgttgcctgcaggcatcttctgggccttattggatggttgcaccatcctgctgggcttaataccccacactgcccatcccccggagcacctgcatactctggactttctctgctgcctttccatgtccgtggtgtgtagggaaaatgtcccattttctcagggccctgatagctcctaagctcctatattaactgtgctccagtattaataaatgtgtaggtactaggttttatatttctagataccatttgcactttagcaaatgtactttatgctttaacccataaggtgactaacagagggtgttcaaataatgtgctagaccctttttttaaaattaattctacctactttgttttttaaatttttattttattttactttaagttgtgggatacatgtgcagaatgtgcaggtttattacctaagtatacatgtgccatggtggtttgctgcatctatcaacccgtcatctaggttttaagccccgcatggattaggtatttgtcctaatgctctccttcccctcgctccccacccaccgtcaggccctggtgagtctctgtgtccatgtgttctcattgttcacctcccacttaggagttagaacgtgctatgtttggttttctattcctgtgttagtttgctgaggatgatggcttccagcttcatccatgtccctgcaaaggacatgttctcattcttttctatggctacatagtattccatggtgtatatgtaccacattttctttatccagtctatcactgatgagtatttgggttggttctttgtctttgctattgtaaatagtgctgcagtaaacatatatgtgcatgtatctttatagtagaatgatttacgttcgtttgggtatatacccagtaatggcatggctgggtcaaatggtgtttgtagttctagatctttgaagaattgccacactgtcttccacaatggttgaactaatttacattcctaccaacagtataaaagcattccaatttctccacagcattgccagcatctattgtttcttgactttttaataatcaccattctgactgctgtgagatggtatctcattgtggttttgatttgcatttctctaatgatcagtgacgttgagctttttttgtatgtttgttggctacataaatgtcttcttttgagaagtgtctgttcatatcctactcccactttttatggggttgttttttttcttgtaaattggtttaagttccctgtagattctggatattaaacctttgtcagatgagtagattgcaaaacttttcttcactctgatgatagttttttttgttttgttttgttttgctgtgcagaagctctttagtttaattagatcccatttgtctgttttgcttttgttaccattgcttttggtgttttagtcatgaagtctttgcccatgcctgtgtcctgaatggcattgcctaggttttcttctagggtttttatggttttgggttttacatttaagtctttaatccatcttgagttaatttttgtataagatttaaggaagggattcagtatcagttttcttcacatggctagtgagttttcccagtaccacttattaaatggggaatcctttctccattgcttgtttttgtcaggtttgttgaagatcagatggttgtggatatgtggtgttatttctgagttctctgctctgttccattggtctatatgtcttttttggtacaagtaccatgctgttctggttgctatagccttgtgatatagtttgaacccaggtagcatgatgcctccagctttgttctttttgcttaggattgtcttggctatacagggtcttttatggttccatatgaaatttaaaatagttttttctaattctgtgaagaatgtcaatggtagtttgatgggaagagcatggaatctctaaattactttgggcaatatggccattttcacactattgattcttcctatctatgaggatggaatgttttccattgtttttccatttccatgcactgattttcttgaacagtggtttgcagttctccttgaagaggtccttcatattccttataggctgtattcctaggtattctgttctctttgtagtaattgtgaatcagaggtcattcatgatttggttctctacttgtctattgttggtatataggaatgcttgtgatttttgcacattgattttatattctgaaactttgctgaagttttttatcagcttaaggagttttgggctgagacaatagggttttctaaacatagaatcatgtcaaatcaatcctgggggtggagccaagatgactgaataggaacagctccagtctacagctcccagcatgagcgatgcagaagacaggtgatttctgcatttccaactgaggtaccaggttcatctcactggggagtgccagacagtgggtgcaggacagtgggtgcagcgcactgtgcgtgagctgaagcaggcctcacccaggaagcacaaggggtcagggaattccctttcctagtcaaagaaaggggtgatagacagcacctggaaaatcgagtcactcccaccctaatactgcgcttttccaacaggcttaacaaacagcacaccagattatatcccacacctggctcggagggtcctatgcacatgtagcctcgctcattgctagcacagcagtctgagatcaaactgcaaggcggcagcgaggctgggggaggggcgcccgccattgccgaggcttgagtaggtaaacaaagtggccaggaagctcgaactgggtggagcccaccacagctcaaggaggcctgcctgcctctgtaggttccacctctgggggcagggcacagacaaacaaaaggcagcagtaacctctgcagacttaaatgtcgctgtctgacagctttgaaaagagtagtggttctcccagcacgcagcttgagatctgagaatgggcggactgcctcctcaagtgggtccctgaccactgagtagcctaagtgggaggcatcccccagtaggggcggactgacacctcacacggccgggtactcctctgagacaaaacttccagaggaacaatcaggcagcagcatttgcggttcaccaatatcggctgttctgcagccaccgctgctgatacccaggcaaatagggtctggagtggacctccagcaacctccaacagacctgcagctgagggtcctgactgttagaaggaaagctagcaaacagaaaggacatccacaccaaaaccccatctgtatgtcaccatcatcaaagaccaaaggtagataaaaccacaaagatggggaaaaaacagagcagaaaaaccggaaactctaaaaatcagagcgcctctcctcctccaaaggaacacagctcctcaccagcaatggaacaaagctggacggagaatgactttgacgagttgagagaagaagccttcagaagatcaacctactctgagctaaaggaggaagttcgaaccaatggcaaagaagttaaaaaccttaaaaaaaaaaattagacgaatggctaactagaataaccaatgcagagaagtccttaaaggacctgatggagctgaaaaccatggcacaagaacgatgtgacaaatgcacaagcctcagtagctgatgagatcaactggaagaaagggtatcagtgatggaagatgaaatgaatgaaatgaagagagaagagaagtttagagaaaaaagaataaaaagaaatgaacaaagcctccaagaaatatgggactacgtgaaaagactaaatctacatcagattggtgtacctgaaagtgatggggagaatggaaccaagttggaaaacactctgcaggttattatccaggagaacttccccaatctagcaaggcaggccaacattcaaattcaggaaatacagagaatgccacaaagatactccttgagaagaccaactccaagacacataattttcagtcaccaaagttgaaatgaaggaaaaaatgttaagggcagccagagagaaaggtcgggttacccacaaagggaagcccatcagactaacatctgatctcttggcagaaactctacaagccagaagagagtgggggctcatattcaacattcttaaagaaaagaatttccaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaacttgtaccagccactgcaaaaacatgccaaattgtaaagaccatcaaggctaggaagaaactgcatcaactaacgagcaaaataaccagctaacatcataatgacaggatcagattcacacataacaatattaaccttaaatgtaaatgggttaaatgctccaattaaaagacacagactggcaaattggataaagagtcaagacccatcagtgtgctgtgttcaggaaacccatctcacctgcagagacacatataggctcaaaataaagggatggaggaatatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactatcctaaatatatatgcacccgatacaggagcatccagattcatagagcaagtccttagtgacctgcaaagagacttagactcccacacaataataatgggagactttaacatcccactgtcaacattagacagatcaacgagacagaaagttaacaaggatatccaggaattgaactcagctctgcaccaagtggacctaatagacaactacagaactctccaccccaaatcaacagaatctacattctttttagcaccacacctattccaaaattgaccacgtagttggaagtaaagctctcctcagcaaatgtaaaagaacagaaattataacaaactatctctcagaccacagtgcaatcaaactagaactcaggattaagaaactcactcaaaactgctcaactacatggaaactgaacaacctgctcctgaatgactactggggacataacaaaatgaaggcagaaataaagatgttctttgaaaccaatgagaacaaagacacaatataccagaatctctgggacacattcaaagcagtgtgtagagggaaatttatagcactaaatgcccacaagagaaagcaggaaagatataaaattgacaccataacatcacaattaaaagaactagagaagcaagagcaaacacattcaaaaactagcagaaggcaagaagtaactaagatcagagcagaactgaaggagatagagacacaaaaaacccttcaaaaaatcaatgaatccaggagctggttttttgaaagatcaacaaaattgatagaccactagcaagactaagaagaaaagagagaagaatcaaatagacacaataaaaaatgacaaaggggatatcaccaccaatcccacagaaatacaaactaccatcagagaatactataaacagctctatgcaaataaactagaaaatctagaagaaatggataatttctcgacacatacaccctcccaagactaaaccaggaagaagttgaatctctggatagaccaacaacaggctctgaaattgtggcaataattaatagcttaccaacccaaaaaaagtccaggaccagatggattcacagccgaattctaccagaggtacaaggaggaagtggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaacatcctcaataaaatactggcaaaccaaatccagcagcacgtcaaaaagcttatccaccatgatcaagtgggcttcatccctgggatgcaaggctgtttcaacatacgaaaatcaataaacataatccggcatataaacagaaccaaagacaaaaaacacttgattatctcaatagatgcagaaaaggcctttgacaaaattcaacaacccttcatgctaaaaaccctcaataaattaggtattgatgggacacatctcaaaataataagagctatctatgacaaacccacagccaatgtcatattgaatggacaagaactggaagcattccctttgaaaactggcacaagacagggatgccctctctcaccactcctattcaacgtagtgttggaagttctggccagggcaatcaggcaggagaaggaaataaagggcattcaattaggaaaagaggaagtcaaattgtccctgtttgcagatgacatgattgtatatctagaaaaccccatcgtctcagcccaaaatctccttaagctgataaacaactcagcgaagtcccaggacgcaaaatcaatgtgcaaaaatcagaagcattcttatacaccaacaacagacaaacagagagccaaatcatgagtgaactcccattcacaattgcttcaaagagaataaaattcctaggaatccaacttacaagggatgtgaaggatcccttcaaggagagctacaaaccactgctcaatgaaataaaagaggatacaaacaaatggaagaacattccatgctcatgggtaggaagaatcaatatcgtgaaaatggccatactgccccaggtaatttatagattcaatgtcatccccatcaagctaccaatgactttcttcacagaattggaaaaaactactttaaagttcatatggaaccaaaaaagagcccgcattgccaagtcaatcctaagcgaaaagaacaaagctggaggcatcccactacctgacttcaaactatattacaaggctacagtaaccaaaacagcatggtactggtaccacaacagagatatagaccaatggaacagaacagagctgttagaaataatgctgcatatctacaactatctgatctttgacaaacctgagaaaagcaatgggaaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctacgaaataccattcaggacataggcatgggcaaggacttcatgtctaaaacaccaaaagcaatggcaacaaaagtcaaaattgacagatgggatctaattaaactaaagagcttctgcacagcaaaagaaactatcatcagtgtgaacagacaacctacagaatgggagaaaatttttgcaacctactcatctgacaaagggctaatatgcagaatctataatgaactcaaacaaatttacaagaaaaaaacaaccccatcaaaaagtgggcgaaggatatgaacagacacttctcaaaagaagacatttatgcagccaaaaaacacatgaaaaaatgttcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttgatgggactgtaaactagttcagccattgtggaagtcagtgtggcaattcctcagggatctagaactagaaataccatttgacccagccatcccattactgggtatataaccaaatgactataaatcatgctgctatgaagacacatgcacacacatgtttattgtggcactattcacaatagcaaagacttggaaccaacccaaatgtccaacaatgatagactggattaagaaaatgtggcacatatacactatggaatactatgcagccataaaaaatgatgagttcatgtcctttgtagggacatggatgaagctggaaaccatcattctcagcaaactatcgcaaggacaaaaaactaaacaccacattttctcactcataggtgggaattgaacaatgagaacacatggacacaggaaggggaacatcacacactggggactgttgtggggttgggggaggagggagggttagcattaggagatatacctaatgctaaatgacgagttaaggggagcagcacaccaacatggcacatgtgtacatatgttacaaacctggacgttgtgcacatgtaccctaaaacctaaagtataataataattaaaaaaaaaacatgtcatctgcaaacggagatagtttgacttcctctcttcctatttgaatatcctttatttctttctcttgcctgattgccctaatgagaacttccagtactatgttgagtaggagtggtgagagaaggcatccttgtcttgtgctggttttcaaccagcttttgcccatatagtatgatatcagctatgggtatgtcataaatagctcttattattttgagatatgttccatcaatacctagtttgttgagagtttttaacgtgaagagatgttgagttttatcaaagtccttttctgcatctgttgggataatcatgtggtttttgtgtttatttctgtttatgtgatgaattacatttattgatttgtgtatgttgaaccagccttgcatctcagggatgaagctgacttcatggtggacaagctttttgatgtgctgctggatttgttttgacagtattttattgaggattttcacatcgatgttcatcagggatattggcctgaagttttcttttttgttgtatctctgccaggttttggtatcaggatgatgctggcctcataaaatgagttagggaggagtccctccttttcagttgtttggaatagtttcagaaggaatggtaccagctcctctttgtatctctggtagattttggctgtgaatccatctggtcctgggctttttttttttggttggtaggctattaattactgcctcaatttcagaacttgttattggtctattcagggatttgacttattcctggtttagtcttgggaggatttatgtgtccaggaatttatccgtttcttctagattttctagtttatttgtgtagaggtgtttatggtattctctgctggtagtttgtatttctgtggggtcagtggtgctatcccctttattgttttttttattgtggtctatttgattcttctttattttcttttttattagtatagctagcagtccctctattttgttaattttttcaaaaaaaaaaaacagctcctggattatttgattgtttgaaaggttttttgtctctgtctccttcagttctggtctgatcttagttatttcttgtcttctgctagcttttggattattttgctctgcttctgtagttcttttaattgtgatgttagggtgtcaatctgagatctctccagctttctgataagggcatttagtgctataaatttccctcttaatactactttagctgtttcccagagattctgatacattgtctctttgttctcactggtttcaaataacttgatttctgccttaatttctttatttacccagtagtcattcaagagcaggttgttcaatttccatgtagttgtgtggttttgagtgagtttcttaatcctgatttctaatgtagttgcactgtggtctgagagactgtttgttataatttctgttcttttgcatttgctgagcagtgttttacttccaattatatggtcgactttagaagaagtgccatgtgccactgagaagaatgtatattctgttgatttggaatgaagagttttgtagatgtctattatgtccacttgatccagagctgtgttcaagtcctgaatatccttgttaattttctgttttgttgatctgtctaatactgacagtgggtgttaaagtcttccactattatcgtgtgggagtctcagtctctttgtaggtctctaagaacttgttttatgaatctgggtgctcctgtatttggtgcgtatatatttaggatagtttgcacttcttgttgaattgatccctttaccgttatgtaatgcacttcttggtcttttttcatctttgttggtttaaagtctgttttatcaaagactaggattgcaacccctgctttttctttgctttccatttgcttggtaaattttcctccatccatttattttgagcctgtgtgtgtccctgcatgtgagatgggtctcctgaatagtgcacacccgtgggtcttgactctttatccaatttggcagtccgtgtcttttaattggcacatgtagcccatttacattaaaggttaatattgttatgtggtaatttgatcctgtcatcatgttgctatctggttattttgcacactagttgatgcagtttcttcatagtgtcattggtctttatattgtggtatgtttttgcagtggctggtactggtttttaatttccatatttagtgcttccttgaggagctcttgtaaggcagtcctgtggtgactaaatcccttagcatttgcttatctggaaaggattttgtttctccttcacttatgaggcttagtttgactggatatgaaattctgggttgaaaattcctttctttaagaacgttgaatattggcccccactctcttctggcttgtaggatttctgctgagaaatccactgttagtctgatggacttccctttttaggtgacctgacctttctctgtggcttcccttaacattttttttttttttttcatttcgaccttggagaatctgatgattatgtgtcttgtgttctctgtgtttcctgaatttgcatgttggcctgtcttgctagcttggggaagttctcctggataatatcctgaagtgtgttttccaacttggttccattctctccatctttttcaggtacaccaatcaatcgtaggttcagtctttttaacatagtcccatatttctcagaggttttgttctttccttttcattcttttttctctaatcttgtctgcatgctttatttcagcaaaatggtcttcagattctgatatcctttcttctgcttgatcgattcgactattgattcttgtgtatgcttcacgaagttctggtggtgtgtttttcagctccatcaggtcatttatgttcctctctaaactggttattctggttagcaactcctgtaaccttttattaaaattcttagcttctttgcattgggttagaacatgctcctttagctcagcggagtttgttattacccaccttctgaagcctacttttgtaactcgttcatctcattctctgtccagttctgtgcccttgctggagaagtgttgcagtcattcggaggagaagaggcactctggcatttggaattttcagtgtttttgccctgatttttcctcatcatcatggatttatctaccttttatctttgaggctgatgacctttagatgaggtttttgtatttttgttgttgttgttgttgttgatgttgttattgttgctttgttagtttttcttccaacaggcaaggcccctcttctgcagatctgcttcagtttgctgggtatcctctccagaccctgttcacctgggtgtcaccagtggaggctacagaaaagcaaagattgccacctgctccttcctgtggaagcttcgtcccagagagtcactggcttgatgccagccagagctctcctgtatgaggtgtctgtcagccccttttgggaggtctttcccagtcaggaggcatggggtcaggaatccacttgaggaggcatctgttccttagcagagctaatgtgctgtgctgggagaatcccccttgtcaggatcagctgctcttttcagagccagcaggcaggaaagattaagtcctttgaagctgtgacagcacccatccctccccccgggtgctctgtcccagggagatgagaattctgtctgtaagcccctgactggagctgctggatttgctgcagagatgccctgccccgtgaggaagaatctagagaaacattctggccacagctgcttcgctgtgctgtggtgaattctgctcagtccaaacctctcaatctccttagcactatcagggggaaaccacctactagagccacagtaatggaggtcgcctctcccccgaccaaacttgaccatcccagtccgactccagactgttgtgctggcagcgggaatttcaagccagtggttcttagctcactgggctctgtgggagtgggacttgctgagcgagaccacttggctccctggcttcagccccctttccaggggtgtggatggttttcctgtctcacgggagttccaggcactgccggagtatgaaagacttctgcagctcagtgcctgcccaaacagtggtctatttttgtgcttgaaacccagggccctggtggtgtagatgcacaagggaatctactgatctgtggattgcaaaaatccatgagaaaagtatagtacccgggtaggtgggacagtctctcacggcttcccttggctgcgggagggaggtcaccgggctccttgcacttcccagatgaagtgacgcctcaccctgcttctgcttgctctccatagatcacacccactgcctaaccagtcccaatgggatgaaatgggtaccttagttcggaatgcagaaatcacctgccttctgtgttggtcttgctgggagcagcagactagagctgcttagctgtttctatttggtcattgtggcccccactatgctagagtgttagggagaatattttgggatagagaagttgttctggttgcttagtgctactgaataaagtacctcctatcccaagtagtagcttcaaacagcaattttattttgttcataatgttgcaggccaggaatttggggagtgcttgcctgggtggttcctctctgatccatgggaacttagctggagtggccagagcatctacttctgtcatattctgtctgtcagagcagtcacaaggctttcccagataagacaggggaggggaactggccctatcctctgaggggatgcagcaagatctcaccacaggagtctgtgggatgggcaatgctgtgactacctttagaaaatacggttcacataggaggtttccaggcagatcagatgctcatgtggaggaatctgtaaccccagtccaaagaattatgatgcagaaaacatgtggcacaagaggccaaaataatatcttccatctgcaccccacagaggaaaggaagttgctattaagaagaccaagaaaatccgtgtctaccctcactcacatcctacaccccctaactcctaaactggttcttgtaccccattccccaaacttcctgtacccttatctgctaaacttcttgtactcatctacaggtactgaaaatttctctaacatatgtagaaaacttttccttccaatgcaaaatataaaacttaaaattgtcatactaagccctgcacaagcttgacagcaggggctctccggagatttagttgtgagaacaggaaggcagcatgagccccagggttctgctgcagcatcaggggaggggaggagaggaggcactctggggagagcgacggtcaggaaggagcttagccatctccatctcacaggggaacccaggggcactgctagactggaatgtctctactgactccttggtttttcccattcctgacactgtcattaactgactcctactggagacccctgtctgccacatgggcctcagtattgcaggtgtttgtgagctggaccccggagcatcaccctttaagaacttggctaggatggcaggttggggataaagctgccaaggagcatttttatttctgcatgttaaaacagcccttgcctggccacctgggttggagggtttgtaattttgtctcagccactgcccatcagctgcaagggtgctattaaaggcaatcttggtgttactgcagtgaaatgtcagctgagagctgcatttctcagctaacttggagctggggcacccatatcctcttgctcgagtgtggtatgaaattgaaactgggctggggctggattctgtcctccagatgagctgcttttgaaaggaaaagaatctctgtaaaacctgggaatcaatctgactggtgatgctccatacaggtggccaaccctcaggcttccctgtggatcatcagcttggtggcttctctgtggtggccctcttgccccattgacctgcctctcatcttgcccaggttccctttccctctgggaactgaggccaggtaaggagacctgggctttttcttcttattattgttattatttttttgagatggagtcttgctctgtcaaccaggctggagtgcagtggcacaatctcggctcactgcaacctccgcctctcagcttcaagtgattctctcaactcagcctccccagtagccgaaattataggtatgtgtcaccacgctcagctaatttttgtatttttagtagagacaggatttcgccatgttagccaggctgttatcgaactcctgacctcagatgatccacccgcctcagcctcccaaagtgctgagattacaggtgggagccaccacgcctggccagcatggactttttctataacaagcctgagcctgggctgggatcataaactgtctggaaaataaaaatcatatcctgaattgacagggcaaaagaaacacattttggatatttcacagttttctgtcatccataccgctctctccttcctcattgacaactgaaaagtgaaggaaaatggcacaggttggccaggtctgtggactgaaaacccaggaagcaggggaaagagaagtgtgtgtaacccacagaggagggtaggatgatttgtggtggggtgcgggcagaaggcttgcactttctgcctcattgattgccacggccccctgtgcaggatacagaggcagttggacaagccttatgcatcctgggctttggtgacatcagcaaagtagagatcatagtcatgtcttcctcatagggcagtgtcttagctgttcaggctattcaaacagcataacatagaccaggtgccttaaaaacaacagaaatttatttctcacagtcctggaggctgggaagtctgagatcagggtgccagcaggtttggtgtctgctgagggacacaattcatagatggcatcttgctatgtcctcacatggtggtggagggggcaaggtagctcactggggcctcttctataagggcactaatcccattcatgaagctctgctctcaggacctaatcaactccctaaggcaccacttcctaataccattgaattgggggttaagtttcaatatatgaattttgggggcacattccatctatagcaggtggacaggaagattccatgaaacaatacatgcaaagcaccaaaaatagggcctggaatatagaaaacactcagtaaatgtttgctgtcactacctctattactatagaggaataaatgaaggcaaaatgaaatagtgaggtgacaaggtaaaagggaaagcctgccatgtcagatggccattggcaagcttggcttctgatccccactctaccagtaactattctgtgaccttgcacaaactctttaacttctctgagccttggattcccctcctaccaactaagaagattagatcagttagtttctaaggccccttctgctagaaaatatattatgagcctgctatgaaaaatgcaaggtcaaggagaacctcctatcatagacctggaaggggaaggaggaaatatgtgcatggaagggttgtgggcacagaggctacaaagctcagcatttgttaatacagggactggtgagtgctgcacagaggctagcctggtgtcctttccttcacatcctgcgtagccattgttctctataataacatcaaaaaatcactagaaacatcaagctcccagttgcctcacttaacagaagcttgggttatgggtacagatggttcttcaacatccattctcctctccttctctgtggcagtagggtcccctttatctgagctgggcacaagactacccagttagagttggtgcttcccaacctcccttgccactcagtaaggtaggtgtctgagttccagccagttgtgtgcagctcagggtcccattcttacaaagatgctgcttgccttcttcctaatcattctaacttcccagggctggaacccagtatgggggtgggtgttcagtttccattgtgtgcatgagataatgatgcaggactttttgctccttaactcagctaggtttgcattcttgtctcacgaccaggaagaattaggcaagtggacattaaagagtgagtggagtagaatttattaagcaaaaggagagctctcagcaaagagaagtgtcctgaaagcaggtttctggttgcccctttcacagttgaataccagggattaaggcgtgaattcctggcagctccactccatccttccagtgtgctttcaggcccttagactgagacactccatattgatttacttcccttaccgtgtatgtgttaaggaatggaattttccactgtgggcatgtttaggcaagtcccctatgcaagttcccttatctgtgcaaaacatctgatgtaagcacttgtggggcaggtcagaggttctccagggtcgcttcccttactatcttcctaaagcaagctggctaactcctttcaataacatactaaggataggaaacctgggtgatcactggaacagtgccactttaacccttaggtcacctgcctacttggacttttcatgagagatatagaaacctatttgtttaagtgcgtgttatctgggttgggttaggtcctagcagccacattagtattatcataaacacaggaatgatgggggttagaaagtggggaagaggaatttgtaatggatctttgttactgaactgaactggggtctcctcacccagctcagtaaagccagacactgacactaagatttgcagcaggagaaaagagcatttattgcagggcaccaagggaggagaataggcagctaatgtttcacacctgaactccccagtggcatgcaagcaagggcttttcaaggcaggggtacatttcaggaaagcagaaattgcagacaaaattataaaccaattacacagaggttatacattgttttggcccatggcatgactttctccagacccctcaggaagaaatttagaacagagaatggcagccagagttcagtcgtcagtttccccttatctgagcattaagtgatagtggtcagcactttccatcttgtggggatttctaaaaacaactcacaacttgagaacatatgttaagatgtcatcttttagtttctatagggaagcaaaacaccttgtgactctggcttgcctgggagactgttgttactatcttcctgcttatcaggttgcttgtttgcttttcaaggctacctaggtgcttggaatttgccttgaagggactcaaggtttttctttatctccatgcttaggaggccaggcaggccatcttgagacaaactagtacttcaaatgtggtgtggtccaaagtctgggttctagtccctgatcaatcagcccaggccagctggattgggggatgtggtggtcatctcagctctccacatgcttgcccccttgatgcaggatttttctcagccactttgccagctggagacccccagatgtccatgcccctgcccaggcctcactctgccccaggcttgctgcaggaggtactccacccacttggcctgctgggccatgcctggcttgcacaccagcccagctcccacacttaccatgggatctgcactcatcctgcagttgggctgggtgtgcaccagtccgccagcattacagcttgtatctgtgttcagtggtccctgagttcttgtctcatgtccaagaagaatgaggttatactgacaatccaaagggtgagaagggcagaggacagaccacctgaagttgggtggtctgtctccccgtgtggctgggtccagggcttttatgggctcagaatgggaagtgcatgctgattggtttgtgagtatgtgaaagaggctaaaacaaaggcaccactcaaaggtgggcatgacagtgtaaaaaaccaattagggaatggtagatatatgtaaaataggtgaagcgtggggaacaatcagcggaaagtacacccaaggggaaaagaggttcttaatcaggtctgtggatttatccgagacttgtagcttggctttcaggttttaaactgtctttggcttgaaagttgggtttcagtggggacccacccctatctgcctaggcatttgtctgcctcctgccactatcaccctcctctgtgccatggcagggcctggtctccaggagtgatattctgtgactccctaactttggactgctctaggttctacctcagagtcacttgttaaagggacagatcttcactcactttccagagagggtgagaaattagccaggcagtccatgtgaggcagctgctttataaacattgagcagacatcatttgtaattgggaaggtgatgtgatttcagggtccccatccataaactctctcatgttctattgtgcaccatggtgcttgaacacactagtagagttttattcctggatttagtcattctagtcttcagatgttctagttaaaaaataaatcctacattcactcaccaaacacttactaatgctaagagtggctatatctgtccctgttccagatccagatgctgaagacccagagttgaataacagtcagattgtcttaaaaccatcttataatccacgatgtgtgatgggcgtgtgtgtgtgtgtgtgtgtgtgtgtgtgttaaagcacctgatgatgacaattcttctccactttcaatgcaccaaagaatcaactggagatcttgctaaaaggcagaatcagatcagtcagtctgggggcaggcctgggattctgcatttctaacaagctcccaggtgatgcagataaactggtccaagactaagtttgcgtaacaagagacaataagagtctgatcactgctgtcaactagtgtggaggacccacataggagagaggacatgattgagttgtcctggtcagaggctagcagacgaagcgaagtttacccaagaggtttcacattcagtctagacctctgaggatgaataggccatcagcatccataactggcatgaagaatagtttatcaggcttcttaatgtatttttccatcagcattaatgagacttagccaagagacaattttggttaagagttggtgagtggagaaaaatgggattcatttataacaacagttctcaaacttgagtgtgcctcagaatcactcccagggcttgttcaacacagattacgggtccccactctagagttgtaagtcagtaggagtgggctggggcccaagaatttgcatttctaacaagcccccagtgaattttaagaaccactggtttataacaagaggccccacagggcacagcaagaggggagcctggctatagtagggacaagaactggacagatcgggggataggcagaggaactctgagaaagaaatatgtgggcaaggttgctggaaggggttgggttaagactaatcctgagaccgtaagttgtagtccagcctagctgatatggacaagatattaagaactgactaatgaattgtaagttgcctaagagaaggggcctggggcttgtctacccagtattcctatcaccagcagagtgaagatgtggtcattccaaccaaaattactttctcccttccctcccctctttctgattatgccacattctaggagtctgcctataaaatagaaaactcggtccagcccagtcagctctcagtggacgttggcaccctggggattccttgacagttccggggcctctgtggcttgggcagagagagcctccatctgtggtggcatttgagagctgttgttctccaggatgcagtagctccacagcaaaaaaaaaaaaaaaaaaaaaaaaaagaggcatcatatgcaaatatcaaatgaaggggagggaaggaggaaagggctggctgacattttggctctgcccctagatcctctgagaagagaaaccactcgtgcctgaattaatgttaattcaagggggtattttcaaaaagtggtccttggaggagcaagatgctgtgtttcctattttccgttgcctccagcaagccgcaccgacagagggtcaatggggttactgtatgaggaagcccactaattgcattataaggaatgttttgcccattagctcagatggaatggtctcctaacagagtcctttgaggggagtgatatttcaggtgggggatggaggaaaaggaattgataagtaattgaaatttgcaaatggcatttccctgggccctagacaaaaatgggttccatacatccagcagggggcagcaatgcacgtacattaattccggtcttgtgaatcaggagcttggcgagatctcagaaattgcaaagcagtaaggatgcctggggaggtttatagacaatttccaggcccggcaaagctgggactgtcacacccaccatttccccaacagtcacaccttttatttttctcaatatactgagaaaataaatgtttaggtctgatggtttttaattctagaaattttctttaatctttcggctgctttgtgtaatttagaatttctgcagcctgactgaaaattataagtaaactaggattaggaagtcagctttattaataagatagttcagctaatagacattttaaaattgtaatgcaatctatctccctccctgagttgaaattttgctagagctgtaactgataggacacccacacaccaagttgggtaacttatttgctgatccattttaaagtggaggaaaagaggctccaaaaatataaataaagataaaagtctcaaagaagtatcagattttcctgaattaggcacagaaaagacctactagtttgtccattcctaaggctgtttaggaatgtggcccataatatattttctcagtaatttgtcaaatttgcttgtaaatgacttttatgatagatggctttgcctgctttactgggctggaaatttctgcagcccagcacacttctccttcaggaagcttcttgcatcttgcataatgtttctcccagccaccctccccgcttacgccccttcccaaggttaatttagtcctgttgttcttaaatgaactactctaaatcatcctcctccccttccctgtctttctcctcactgtttaaacctttcaaggatgtaatagtctggcaaatatttcaatcatcatgtctccttttcagctgcccaattcaattccatttggtgctgctcgtgctgaagtgcaatttttcacagcattgtttttagtttaaataacatacagtgcactattgctaaaggtcttctggaacattccacttgggggtcttacccttaaataatattttgatgggaaactaactcaacttttcataggaagaaatgctatttgctcccagcactaattggctgtaaatttagctaaaagtccatctacgctggcagttagaccatcttcctgtgcccatgtggtaccctgtattagatgtctaatggacagacttagtgaataagtatgtatctgtaagtgcaccatttagaaaacaatcaagtgaaaggaatttaactctgctaagccagcaaatgtaatttttctcatttcttgccccttcttgccacgtggcagctcctcaatttaccagctctatgcccttgcatgtattactcaacatttctgagtctcagtttcctcaactgcaaaatagggaaagcaatatctgctttctaggttttgttgtagggatcaaataattatgtacagcatttggtaaaacataagtccccaagaaatgcaactttttgccattattattatcactactcttatcattatgcagtctaaattctatgcctgggttatctttcagagttcctgactgcctatacattcacattgttcaacaaatgttacttagggaaaccgtctctgaccccctggaattggccaggttcccctgtgattcactgtcacagatacgtgtgtgtgtatgtgtatatgtattcttatattattaccctcaaattaaatgctcccttcttcataaattcagagcagctaatatcctctcttctctccttaatggtgtgtctaacataccttcatatcctaggcttgactaggaacttctcataggcaggagcagagccttgcctttcaatggagcctggattgtcacatagaaatgagcacatagaggtctgtggtgtgtacttgtgagactatcagactgtaatatctttgaattcagggaaaaggctaattcaccttcagttcccagagcataccacaccccaagcctgtacatggtaggcattcgagggaggtctactgtgtcgattaaggctgtgcattggtcttccaaactttgctcaccatatacaggtttccttcagagtcccagtgtccatattactgtttaacacgactgaaaaggaacaaaacgaaatccccaccttcaccctctcactttgactgtgggtgatttctgtaattaagagcttcaggaggtcgggcacggtggctcacgcctgtaatcccagcactttgggagacagaggcgggtgtatcacgaggtcaggagattgagaccatcctggctaacatggtgaaaccccaactctactaaaaatacaaaaaattagccagacgtggtggtgcgcacctgtagtcccagctactcgggaggctgaggcaggagaatcgcttgaacccaggaggcggaggttgcagtgagccgagattgtgccactgcattctaatccggtgacagagcacgactccgtctcaaaaaaaaaagagcttcagatgactttctaagatacactccctaagaatctcatataacgaatggcctagaacatgacttctttattgttaacctatgttgatgccaagagatcagtgtgtctttttgtgatgctcataaacaacctattaaataatccgttttccatttttaaggaggacttaggtgcatgtgcatgagtctgtgtgagttggtgggagaccaaagggagacagagtattctgaaagcccaccgaattattcagctctattttctggcccagaattcaccagatagcacaaaacaagctaaatcatggcatgataaaacactgcagcccggacaatgaatatgcaaatagcataacagagttaagtactgagagagccatctattgtagatagtttagcttccctttagtgaaagatcaaggacagaaacacaaaaagatcatgctaattttaaaaagagaaaatagatgctagctaacgtgaaaaggatgaatataaggaggcgttggatcagtccccccagggctcagcagttctggaggatggcaagcccgagtctttggatacaaggaacagcgcgatacaacggaggtacttgcctcttggaaaacacacttgcactctgtgttgcatctgtggtttccatggtatgaagctgccactgtgtttgttccaatgcactttgaaaagacagggcacatttatgagcaaaggcatatggctttgtcctttcaagcttatccaaggctttagaatgtcaactgtagtggctggaaagcagccagcaaattaggaggctacagaagaatttcgtgagcttttaaaataatttatttcagtttatcgtttacatagaatgtcagatctgaaggggaccccaggagttatccagtctaacttcatattataagtgataaaatgaggtccagcaaaaagaagtgatgttactcatagcgagagtttgaatgtgctgttcctgattcatacattagtgattattccattatacctagctgtatttctgtccagactatttttataatgctgattaagctgggctgttttggtgaattttaacatttcccatagatttttaccatgtgtaattttggaaagggggctttgttaaagtattagaagacctactatagtagtttcttgtggtttaggtggaggaagagcactgatggcattttctgttgcagtaagtttgttggttgtaatatagtttttggttacaaggagcagaaacctgaccacagctgtttgaaagaatataagttcatttttccactacaagaattctggaagtaggagagtttggctttggttcagcagctcaacgatgttagagttgatgtctgattatctcagcctttgcctcagtcataagacaactgccacagtgccagccatcatgtctgcatttgatgcaggaggaaagagaaagagggggagcaaactgcatcttccgtgttattgggggaaaaaaaaactttcccagatatgtccaagaagtcttctgtttagatctcactagccagaattggccatgatgcaaagaagttgaaaaaaggatgtcccttataggcttagattagtcatgacccttcccccagggcttgacacataatcaggagcttgtaatgctgaggaagaagagggcaataactgagggctccatatcaccctaaaactgtccacattcccatttgtatgtaatatgtttggagtacaagcttgatgcaaggatgggcagtggaaggtttttggtgtctgattctgtcatctctttatacctttagtggaagattatttcccaaccaaaggcttatctgaggataacaaaacaattccattgccagacatttatagagcccaacctgtggaaacaataaatgcctgaaacagtttacctgcactatatttcaacttctgaaatgtagatcgagaggataaattttatgaaaagttcactaaaagtaaatattgacaagtggttaaatctcataaaagacataattttaaaatgctgcttgcacctatagttctgttaagtcaaacggcaaaacacaactctgtgctcggttctctgctaggcagttgggatccatcactgagaaaataagaaaaaacatttggggcacaggacttggggatgtattagtcagggtcctccagagaaatagcaccaataggatgtgtggacagtcacccctttgtaactgtgggttccacatctgtggattcaaccaacagaatggcagataaaaaatatttggaaaaaaatatatctatactgaatatgtacagacttttctggctattattccttgacacagtatggcataacaatatttacatagtatttacattgttttaggtatttgatatattaatagtttggatatatgtccttaccaaatctcatgttgaattgtaatccccagtgttagaggtgggacctggtcggaggtgtttgggtcatgggggcggatccctcatggcttgctgctgtcctcgtgatagtgagttctctcaagatcttgttgtttaagtgtgcagcaccaccccaactctcttgctctcactctgccttgtgagatgcctgttccaccttctccttctgtcatgactggaagcttcctgaggcctccctagaagccaagcagatgccagctctatgcttactgtacagcctacagaacaatgagccaattaaacctgttttctttataaactacccagtctcaggtattcttcatagcaatgcaacaacagcctaacacataataatctagagattatttaaaatatacaggaggatgtgtgtatgttatatgcaaatgctataccattttatatctggaagttcggcatccttgaattttgtaaatattggcaagcctttaagtctcataaaagatgtaattttaaaatgctccctgtgcctagagttctgttaagtcaaaccacagtagcctaccaatgtgtatatatgtgtgtgtgtgtgtgtgtgtgtatgtatatatatacatatatatatatacacacatatatatatacatatatatacacatatatatatacacacatatatatatacacacacatatatatacacacacacacacacatatatatatttttttttttggaaacagagtctcactctgttgcccaggctggagtgcagtggttccctgcaacctccacctcccaggttcaagcaattctcatgcctcagcctcccaagtagattggattacaggtgtgcaccaccatgcctggctaatttttgtatttttagtagagatggggttttgccatgttggctaggctggtctcaaactcctgacctcaactatgcctcccaaagtgctgggattacaggcatgagccaccacgcccagccacatatctatgtatattgatataccttggtatcctcgggaggtcctggaaccaatccccctcccctcacggatactgtatatatacacacatatgtatatatgtgtgtgtgtgtgtgtgtgtgtatgtatatgtgtatatatatatgtatatatgtatatatgtgtgtatatatatagtgtatatatacgtatatatatgtacacacacaaatatatacatatatatatataccattagatgtatgctgaaagattcaaaaagtcttgaatgagcatctactacatgtcaagtgctatgtaaagcagggagagaatggggagtgacacagtccctcctcgagggacacaaccactggatgagatagacaagcatagagaccctcacaggctgaatggtggctgccctgagtgagcacagagctcacggggtgtgcaggggcaggcacggctgtcctcactgagttggctgccctctggggtaggcccagtatgaggtcccaagagctggactgacttagctcaggttcccaggcctagaacctgaacccagaccacctggcttgtcatcctgccttagcagaaggcctctctgaaacccacaagcagattcttgacccagtgagcatgagtcctttactctgcctgaaaaaaacaccaccaggtaacatcaggggctggtggtccctgatggcagtgcaatacattggccacagaggacatgggtattgtggaatcagaagatgcttgttgccacagcaaagaagagcatgatttcctggaaggcaacagaccccatggagatgaggctgctgtagcctctacctccctcattcatgctgcagaagtatagccttcctctaacagttgagggtctgaaacttctctgctttcctcagcccttgggagaaagcctaatgatccaaagcaagctgaatggagtcagtagacatggaaaactgggagccgtggtggccttcagagaagagaaccgatggctggctagagagcctggcttctgtaccttttggattttgtacaatgaacctgcattaactttaggtatgatgttaggcaagctgatagcaaaggcttttctgagtaaagtgagagtccctgaaggccatgtgctagattacaaacatcatgggctcagagtcaacagtcacagctctgccacttattatttgggtcatctcacttatctgcttcaaactgcagtttcacaccaggaaaatgggatgctcatgagtttgtggtaaggaatgaatgaggggatttatgtagatagttgaagccagaagttggtcttgtctgttggccttgagacacaggtaggctgaaggccatcactgatgtgcagccctgggtccccagctgatagctacagtgacctgccccatcagcaacaagcacttcctattcactctgctcaaaaagccaaggaagtatgtcatatatttggagagggggcagattaaaatgctggcagggcttaaagggggagggaaaacttgactttgcagcacggctcatttctcaaaggatctgcacaagcattttctccccctagatatgcgctatctcttaaatcaacaataagtaatgctttacaaactttttagtgcacacatctctcccacataaacagtaagcttaattctggaaaagacatactttcatacgtgtttgtaccgttcaaaccccacacatggctgccacattcacttccactttcaaccatttttttttttttcctgagatggagtcttgctctgtcacccaggctggagtgcagtggcacaatcttagctcactgcaacatccacctcccaggttcaagcgattctcctgcctcagcctcccgagtagctgggactacaggtgcgtgccaccatgcccggctaattttttgtatttttagtagagacggggtttaccatgttagccaggatggtcttgatctcctgaccttgtgatccacctgcctaagcttcccaaagtgctgggattacaggtgtgagcctggcctcaaccacttttaacacagaataggttggtaatctattgctgtgaaacaaattacccaaaacctagtgccttaactctaacagtttcttttggtcaggaatgcagaaggggcttggttggcctgctgtgtttcagggtctttcgtgaggttgcagtcagaagtcagtgtgggccgcagtcatccaaaggctttcctggggctggagggtctgcttccaagatggtgcactcacgcaactggcaagttggtgctggggctactggtgtctctgttttattctgggtagggctacttgagtatcttcatactatggtggctgggtccctcaaagcaagtacccccagaaaccaatggaagctttgatgcctttgatgattcagcttcggaagtcactcattagcatttctgagtcctctattggtcatatagaccaccagtgattcaatgtgggaggagattaaataaaggcgtgaataccagggctagccctggaggccaacttcaaggctgactatgacacagagctgagacacaaaggtacttagttaagcacctgataatttgttgatgacatgattgtgcataatgtgaatataacatatacatggtaagaggtgaaagtgtgtttgttttacttttaggggagatgttactcaagtatcccaaacttgagtgttcattagaactacctggagggcttatggaaacataaattgctgggccccaaccctagagttcctgattcagcagatctagggtgaaatgggagaatttgtgcttctaacaagttctcacaggataatgatgctgctggtccagggtcgtgctttgagaactactgccctaattgatatagagacctagtggtccttcaagaaaatttgcttcaatgcaaatacatccttggcctcttatagctgagtgcccaaactgtcaaattcattaggcatatcatttttaatttgacgttttccaaatggcacagagtttatgtaaatgtacgaatcagagagacagtatatggacagcctaagtagtggtatgctggcaaactggctctcctcccaaaataaaaagctttgatttgtaacttttgccagtttccatagtgtaaatgctcccaccatggccaattaccaatagttaactagctcacaaaaattcctatttcacagttgactctgtagctggtacatgctggccccagtacaccattggctctaagcaagttctttccctgcacatatgaatcagagaaagtagtggcctatgtgggggttggggatcactgggtgattctaattgctagtaccttgtgcaccaaacaaaggcggtcaaatgccaggtctgattttcttcctacctggagtgtttgagtctttgaggtagctaaagtgataggatgtgattatgcatacaatgctatgtggtgcaggcacatctaaaatggacttttcaaatcctccccctccacacagtctccttaatctacccccacttggacaattctactgaccgctccaggccttctgtcctaattaagcacaacctcatagacactcctcctcaaaggcctctctggctttccttccctttgaagacaccaaggctcctttccttagggtaggtgacaggaaatactttactgaaatccattctttgagctgccaagatgcccagtgagggtataatgtctgagtgcctgtagaaattgggtagaacatttatttggcaattcaccttgtagagggctgtttatcacattgaactgttgtttaaaccttaacttatggccaggtatggtggctcatgcctgtaatcctggcactttgggaggccaagggggggggcagatcacttgaggtcaagagttcgagaccagcctggccaacatggtgaaaccccatctctactaaaaatacaaaaattagctgggcatattggtgggcacctgtaatcccagctgcttggaaggctgaggcaggagaatcacttgaacccaggaggggaagttggagtgaaccaagatcgcaccattgcactccagcctgggcaacagaatgagactccatctcaaaaaacccccaaatccttaacttgtaggattttttagtgtgttccctcacagcgtctaccatggggttttggacaaaataagcactaagcatttcatgagttccaactttgaattctttctcttgcagaaaacactggcattttaacagagagcttcaggtgccttaatgccagagagtgggtcatttgggaattctctcatgggattcaattaccataagagaaaagtggaataaaatgttttggtagtgtaagattagctgaaagaaaggatgagagagagagagagagagagagagagacccaaggtcaggcaagtaagtttattaacctgccaggctgctccaccgcagtcagaggaggcagccctgagcttaaaaaatgaggggtttatatgggggagagagaccctagggttgtcggttaactttaccacatatcttctcgtgactggcttacaatatagtatcttgtgaaaacatgaatttacaagaggatgtaacttaggtttatccgcgtttctcgtgacctcccccatgccgcccgggggggctgtaatcagggttcactcggcaagtctggtgaccttgctgtggcacctagataagggttcagggatgcagctgcagagtattcagggtaagggtcagctgcactgagtggtggtggtggtggggtgggggtggtcctggggcagcttgtccctaacagctaggaaagccttttagggcttcttttttgttatataaaggatacgttctcagaaaaatgggactcatgctgatccagtgcaataataacaacaaaagcccagcatttgaggtaggcagaatgtgacccctacagaagcgtcatcctccttagcttctctagctctgacattctgttaagtttcttagtctctctaagcctcagttacttggtctgtaaaatgagactagcaatacctgctctgttgtctcttgtgaggaggaaatgagaatgtgtgaaaagtgctagaatggagcctcatgggggaggctctcccaccccatgtcctgatttggacaaggaatcccacacacctcatccagatacacagaggctcatgactgagtctcttgacaaattattttttgagggtgcatacttttttgctgtgaatttccaaatgtttgcatttctaaggccacatttgtgacacagagatcagatcctttctgacacaatgtaactggcaggtcctaatgagctgggggcaccgggaagcattttaagtggtagcatttctggaaatattgagatgaggtcgggggaaagaagctttttcttcagggcctaacctgattaacaagacgatgcacttgagatacatgaaggtggatttctctgcttccagaagctcctgggttctggaaggttatttttatagtatggcaagtaataagcattagtgaccagccatgaatcccagatttggaaaggacgactcctaagacaggggcagacctggaaggaggagataaacattgaataggtgctcagctcaacaggctgcccacagtttacacaagcttcttggctcaatgtatctgtgctagggaaaaaagctcctcttcagttgctccagaagcacatttattaagcactaactgtgtgttaagccccaaaagaaatagaaaaaaggcaaaggacctgattttcatatctaggcatttacagagtagattatgaaaaaggtcatagatagttgtaattatttaactctccttgctataatagaaaatggcgttcatgctcggaatcaaatagagagggttttcatgcttggaaaattcagtaattaataaacttccaatgttttgaaattcatttctttgtagccacttaggaaaagaactgaccgaggttgggatccaggatcggaactttatgtggcatgtaaaataatttgaaagagtgagatatggctttgtaaatttttgtagaaaacaacaaacctgatgatttcccagatttggggggtaacatcaggcacatggagggtgaggtgtttggggcttgaattacagcattttcttttaaacaggcgtgactttccatgcgtagaaaatggtctcagggcttggattaggacgtagagctggaaatcagggagcccgagtttcattcagtgaacacataaacaccttactgagcactgacttcacgtgtcagtgctgaggataagaaaagcaacagcgtggcgccctgatgaagttgatggaagcacgctcagggcagcaaacagctctcccggccaggtcttgggagtagtcagagaggagctaacattgacacagtcttaaagaggagtcgaattggctagaaagaatgaggccagtgttccaagcagagtgaacagcatttcgcagcgtagtcagaaggccacaaatactgtcgttggaaaaggcaagagcattggttctccaagggtaacatgtgttccaatcacctggggacctgtgacatgcaggttctcattcaagagttctgaatgagacttgagagagtacatttctaacaagttcctgggtgatgccatgctgctgcctttagcccacttggtgtggagaggctgtggacatggagcatggagctaggagtaaaaatgggggctgggtggaggaaggggaggatgagggcttgtcacctgggctgatgattgcaccctggcacacttcagctgtactgcatactggtaatagcatccatggtgctcccagcctccaatgggctctgggagctgtctgcatccctcagccagcttagctctctttcccaatccaaatagcagcaacatcctcaacctccaaccgcccacctgccattataaaattcttccctccacccaagcctaagctttctgccagggtctggctgggtttcctcttccttttggcctcccatgggccctcaatacattcatcaccccttctcgatagctcccaccttttgcctttcccacctctttttcctcaaccataaacctgtttggcaccctcctgtcctacagccactgtgctgggaaactggccctgaacctgggtccccttccactgctctccagtctctccccatcctcacaccctgattgcatcgaagaacaaactcacacttgtagtttctctctccttcgtctcatctgttctatgtaatctatcactaccaccattctgccttccccgctctactgaaatggctcatctggagttaacactggccttccgatttcccagtccaggaatttcaggcccagtccagcttgtcctccagaacactttacagtgttgatcaccagtgcccagtctccctatagctctccagattctctttggccccttctcagcctcttttcctggttcctcttcctccatccagtcctcaccaggtaacatttcccagcttctcctctctccaaacatcctgcgtgggcagattgcccaagcctgggaagtgagccactctttctatgctgttgactcaggaactcagcctccttttgcccatctttctgtctattggtcatatttatgtaggtacctcacattttgtttttttttgttttgttttgttttttgctttttttttttgagatggaatctcactctgttgcccaggctggagtgtgtagtggcgccatctctactcattgcaacctctgcctccaaggctcaagtgattcttctgcctctgcttcccgagtagctgggactacaggaacgtgccaccatgcctggctaaattttgtattttttttttcagtagagaaggggtttcaccatattggccaggctgttctccaactcctgacctcatgatccacccgcctcagactcacaaagtactggaattacaggcatgagccactgcacctggcccagtgcctcacattttcaaaacagattccttcttttctctcctaaacctgcttttcctcctgggtcccactccaggtgaatcatacccctaccatttctcttctacagaaatcaaactagggagttcacttgactcctctcccagcctcacctgccatcagccatggtcctggctcctgccccccattaactgctgccttagtgtaggagatgacttcatttcattactcagattactgcctttgtcgtcacctgacctctctgcaaggagctgtggctttcaactttggccacacattagaatcagttggataatgtgatagggttctccagagaaataaaatcattgaatatgagtgtacacacacacacacacacacacacacacacacacacacagataaggaattggcttacatgatgatggaggctaaatgccaaaatctgcagttggcaagctggatacccaggagagcaaagggtatagttccggtccaagtccaaaggcctgagaaccacgaaagctgacggtataagttccagacaaacctggtaggttcaagacccaggaagactcaatgtttcagtccaagtctaaaggccagaaaaggtcaatgtccccctcaagcattcaggcaggaggagctccctcttactccaacttttcattccatttaggctttcagctgattggaccaggcccacccacattagggacaactgtcagctttactaggcctacctattcaaatgttaatctcaacaagaaataccctcgcagacacactcagaatatttggccaaatatctaggcaccccagtccagtcaagttaacccagaatattaactatcacagagaacttttagcaacctgatgtccaggtcacaccccaatctcattgcattcaaatttctgagggtgaggcccaggcatccatttttttttttaaggctctccatatgattccatcgtgcatccaaggttaagagccactgctttcatctcttctccctcagactgattcttcacactgccaccaaagtggttttcttaaaactcaaattggattatatttgatcccctgttcaaaagctttcaatgactttccatcatatttgggaaaattctttggcatgttatacaagcctttttgcatgttacacaaggcccttcatgattggccctgcctaattcttcagcctcattccgtgtgggtgcatcaggacatcgtactcaggctgttctgattcacctctcaggatttcttacggttctctgcatttgcatggactcatccttcagtccagaatgcaatctgtccccagcctattctccttcgtctttaagatcctattttgtcacttacagaaagccttctgagacactctcaagactaggttaaatattccttctttggataccctagcacccagtgctgtcaccaccaagagggagccactggtagatagtagtagatagtaatagatagcaggggttatctactatttacaaagcagcaaaacccagcacacagtatgcactcatgtagcacacctgcatgaatgaaggtatccacctcttcctacatctctaacttcagaacaagctcatgcagcaacaccgagaaagagttgaaagttcaatgagttgttagggcaaaagacttaagtctaaagtaccatatatgctgttaggacatttctcatccttactcaaatctaaatatagcaagtgaaaatgcaatccctaaaaaagcggcattattcccaaagagcctggcagagcagtgtttgctgccacagggaaggtggtcctgtcctctgctcccagtgttataaaatgtgtcctgctacattaagtgcccatgtccactctgattccagggataaggatacaactaagctaattttcaaaaggggagtgtagttcataggatcgcacttgctaacacagtggagcttcactattggcagaacaacagttttcaaacagatcagctattgagaggaggtgattatactcacagcctcctaattttatcaaaggcctatcagccacagtattctttcaagtatgtgcttcccttgagaatgtaaaattagtatcctggctgggtgggatggcttttccctgaaatcccagcactttgggaggattgcttgaggccagcctgggaaacatagtgagacctcgtgtctacaaaaactagctcggcatggtggcacgcacctatagttccagctacttgggaggctgaggtaggagtaaaaataaaatgagtatcctgtttataaaacttcagagcatgtgagatggctcatgccttacaaaaatgagatccaacaaggtttgagaatcactggattatggtgaatgtgaccaccacctggctatgatcagtcattgccttccagctcagagcttctcaaccctggctgcttgttaaaatcctacctgggggacttgcagaaatcccaatgctcaggccttactccaagccaattaaatgagaacgtctgggagtggggccctggcattgttttgctgttttttggcactggtatttctgaaagcacgcagatgatttaaataggtggcctgggctgaggattgctcctctaacttactggttctcaaacttggctgcacattggaattgcctggaggtgcctgggtccccccaccccaaccatggacatggttgtaattggtgtgggatgtgacctggcctccaagccaggatttgtaaaagctgttcagtggttcaaacgtacagcaaagccttgaaaccactgctgcaagcacatcctcccacagcctctaacagcccatttcaccttgaaaagaaaatccattgtcataagcagatgagcaacccaacctgtcaggaacatatttatcctcctggctgacttgaggcggctgaggatcactgaggtgggagtcaccactgaaaatagtcactgtgctggagagcgctggaggaaatgtaatagtgttagtttacacattaaaccctttgataccaagggccctgccacctgcaccaccagccaagcatccctgattcctggctgcctttgtggcccctgtggccttggatgagtggccacccctcccaggaaacattcagagcacattacagataataaacagatatgactaatgagctcaattattgtaaatttctgggtcatttcttatggcatttccctcccttctcctttcatcttatgttcaaaataatttctttgtatttccctatcaacatgtccaacctgagttggcgcactgccccgagtaggtaaggaggagaggacattctgttttctcaccccttcctctgctgactcccacctccacctcatttcctctctgtggcttgtgccaggtgggccagtacctgcaccatcttgagaaaaagttgctcaaaaagatgcatgtaatatcactctccacggagtcttacaaatctaacactttgagggcataatcttcaaaatttctggtttattgatgagtattcttatatgatttctcaacacattggaatcacctaggaagctttaataactatttttttcttttttctttttttttttttttttttttgttgagacagagtctcgctctattgcccaggctggagtacagtggcatgatctaggctcaccacaacctccacctcccaggctcaagcaattctcctgccacagcctcttgagtagctgggattacaggcacctgccaccatgcctggctaatttttctgtatttttagtagagatcgggtatcaccatgttggccaggatggtctcgaactcctgacctcaggtgatccacctgcctcagcctcccaaagtgctgggattacaggcgtgagtcaccactcctggcctttaataactattgatgccataattgacccacagagattctgatttagtggcgtgacgattagccgggcatggggattttttggatgcttcctatgtgattccagtatttagccaagtcatttgtcaatgagagggactgagaaagaagaagcagaaggacactcatagtgaaacatcgctcaagttgcagtcttcctatggactctcccctatgaactcccaatagcctttgtctcatttagattctttataagcacaagcagtgagatgagtttccttttttttttttttttattatactttaagttttagggtacatgtgcacattgtgcaggttagttacatatgtatacatgtgccatgctggtgcgctgcatccactaactcgtcatctagccttaggtatatctcccaatgccatccctcccccctccccccaccccaccacagtccccagagtgtgatattccccttcatgtgtccatgtgatctcattgttcaattcccacctatgagtgagaatatgcggtgtttgattttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacatgtgcatgtgtcttcatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttacatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttagtttcctaggagatcagaagcggggtgaggccacagaaaaatctcaaaagcaggtgtgtttgttttcagtgtcctttcatctctctaggagttttgtcctagggttgctgtctcattgctcacactaccctcctctcctccatgacccatgaaacgtttttgcaacattgttcgggtggcacagatgcaagagaaaaaactcagtattggtgagagtgtgggctggtgaaggagtgggtgattgacaggatgtcttgtgatgcacaagatactgaaggagcttagggtaagtgctccggcttcacgcactgtggtacacataacgttccctggtcatttcccaatacacattccctggccattctccctcagctttccctccaaggccttttccttcccgtgaacatttttctgttctgtgttccataccttcagcgtcctgctgtgggaccagctctgacagccacaatcaatggccttcccgggagccttctccatttgccttcttccttgctggctgctgtggtttgaatgtttaccccctctgaaattcatgttgaaacttaatccccaaagtaacagtattaagaagtggagcctttggccaggtgtggtggctcatgcctgtaatcccagcactttgggaggccgaggcaggtggatcatgatgtcaggattttgagaccaacatggtgaaaccccatctctagtaaaaatacaaaaattaaccgggcatggcggcacatgcctgtaatctcagctactcaggaggctgaggcaggagaatcgcttgaacccgggaggtggaggttgcggtgagccgagattgcaccactgcactccagcctgggggacagagggagacagtctcaaaaaaaaagtggagcctttaaaaggtgattgagtcatgaaggctctgtccccttggatggattaatccactcatggatgaatgggttaatgggttatcactggagtgggttagtcagcacaagcagggtctgttataaaagctagtttggctcatgctccagccctctctctgtgcgatgccctgcacctcctcagcactctgcagggtccccaccagcaagaagaatttgaccttggatttctcggcctcctgaatggtaagaaagaaatttcttttctttataaattacccggtgttaggtattcagctacagaaacagaaaacaggctaagataccagcagaacctggaactttttcaggtatctgaccctgcagcagatggtgaatcttgattagttcaagcagtggtcttttaccttggctgcatattaataacacctgaaaagttctttaaaaactactgatacttgggcctcaccatcgtttaattggtctttcctgtgcggttctcatgatagtaagtttcacgagatctgatggttttaaaaaggggagtttccctacacaagcgctcttctcttgtctgccgctatgtgagacatgcctttcaccttctgtcatgattgtgagtcctccccagccatgtggaactgtaagtccaagagacttcttccttttgtaaattgcccagtctcagatttgtctttatctgctggtgacactggttctgatttaactggccttgagtagggatgaagagttcccatatgattaaaatgtgcagccaagactgaagatcactggtctaggataatcatggcatttcaactccccttgccagtggttaagatagggcaaacaatgccagtttggcagatgaaacatgagaatgcagggatgggagtggggagatttagaaaaagtgtctcacctttaggaagtgatgatgtttctttccttttcatggtcttggagttgttgggcgggggtgtgatgcttgtcgccattgcagctatcttttgactgtgagtggatataccagaggacatagatttctatgatgaggtttgcatgatgcaatgttaaaaacaacctaggttggccaggcacggtggcttatgcctgtaatctcagcactttgggaggctgaggtgggcagatcacctgaggccaggaattcgaaaccagcctagccaacagggcgaaaccctgtctctattaaaaatacaaaaattagccagccttggtggtgggcacctgtaatcccagctacccaggagcctgaggcaggagaatggctggaacccgggaggcagaggctgcagtgagctgagattgtgtcactgcactccagtctgggtgacagagcaagactctgtctcaaaaaacctaggttttcaacagtgtcatcgagctgctaaacaagtcaaatttggaaccccagccctctagttggggagaggtggcttgatagcatgccctgctaaacatgcacagcaccttctgctgggtgtaaagctctcttagctctaaagctgttcactcatcacaggagagctgccaagagccagtggccttgctgggcaggccttatctgctactgagggctttgggcagtgaacgaagacagaatttgggcagattcaggcttgacttctggtcactgtgtgaattgactcaatgaaatgcatagactaagcgccttggttttatcatctttacaatgggactagcacccaagggttgttgctatggttccatttaaagaactcagcacagtacctggcacgttgtaacttcttagtaagtggcaacttttacactttttggtatatttactctccttatgctgcaatgagcaagaggtgaaataattggaaagaataacaagagagatgtttgatttttggaggactagtactctaacagttttgaaagactgaacaagtttttcctgtggtcccctctgcctgaaatttatcaaaataatttgagcctgattcaccaagtcagcacagatgttgggcccagtgtgactggctgagctctatattctagctctgccagctgatgggtttgatggatgcgtggagcccacaaaacccctgctactggtcgtgcaaaggctgtgtctgagcagcgggaccacacctcccttaaggctgagtaccacttgggacagcagctgtggtggggaggggggctgtggagctctgtggggatggggtcctccggctttgagggctgagttctggagtccagtgtcacctagatccagagtcctgaccatactgggtggggcagtgggggtggggggggtcccatcgttccctagagctggctgtcaacctgactgatacagtttggctctgtgtgcctacccaaatctcatcttgtagctcccataattcccatgtgttgtgggagggacccagtgggagatgattgaatcatggggtcaggtctttcctgtgctattaactttagagtgaataaatttcatgagatctgatggttttaaaaaggagtttacctgcacaagccctcttctcttgtctgctgccatgtgagacagggctttcaccttctgtcatgattgtgaggtctccccagccacgtggaactgtaaatccaagagacctcttatgtaaattgcccagtctcgggtttgtctttaagggcagtgggaaagcggactacgaaaccgaccttgtgcctggaagcagaactgggactggggtatcagatcatggtctccagttggccctgagtggttcactggggctccccgggagcccactcactgcccttggccctccccacccagctgattttcttccccagtgtctacagtccttgtttcctcctttctttcttccacctttatccaggcttcaactgccctgctctctgtcccttctgtcacttcccctgttgggaaatgtccccacaccccccactacccctcgtctctgagaccttctctcagttgggctcaatatctgctccagggaagtctccacgttcacatccccctccagccgcacttcctcacttgcctgttttaatcatccttattttatccttatatgccctctactatatctacttctagtccataattccatatccccctcctgccttttcaggagtcttgctgatcagtcatattgttgatcatccttttgccccaaaacctccagtctcattctcagaacttattctttttcatctatttgttaaaatgtcaggtttctcctatcttaaaaacaagacacatgaaaaggacaccctttgccactaatgtcctctacccaggaaggaagaattgtccagatccgctgcccctccactcctcccagccttcctagccctcggcagtgtggcttcctctgtcattacttctctgaatctgccctccccaggggcacagttgacttccttgtgaccaaatccagaatctccctgaggcagcagcctagaggaatgggtgtggctctgcagcacccccgttggttcaaattctgggccaccctagggagaacattgaccttagctaagtttcttaactctttcaatagccttgaaagggtggggcctattgctttcccagggtccaataataaccatagtgaatatttacggcaggcatcctgggcagggcttctgctcagtgcgctgtagggactgtgagttttgtgtatgggagctcgaacatgtttactgaatgaatgagtacattgtgcccaaatagtattaactaggtactttaaattcccacttccaccttcatccccactctgtccaccaggtccctggtttagtttctgattaagaagcgattaaacaaagactgtcttcttaatgtccaaattaaagctatttctagaatcgacatcttacatggatgatttggatctatcctaagactgagcataagaggtatctttggagtgtctgttcatatgaaggtcacattctgaattggtatgtaaattcaggatggttagattaatatcattctgcagcaaaaatttgatcattctggttatagtcagatcaaacacatttttaaaaactctgtaatccaggtcctcttgtgcaatttgtgagactagaaaatcaggggttaaaaaacccatctcaaggtcctagaatgaagatctttacatgagaaagaaaactactctgtaaaaataagcaggtagatgaaatgggcaattaaaataaaacagttgggcgtcttaattgaagtttcattacccttgtccttggaagtaagtgactgtaaactcaagctgggaactggggagtgggatcttactgagtgatggtaaggggttgcggaggcctactgggtgcaccatctgggggtcaggaagtgtgaacagtgtcaaagcaacaagatcatgggcctggctttcaaagagatttcagtctctttgaggagattaaactaaccccataaaaaacacagcattcgatgcaaggctgaataattaagtgctaaattgtggcacagatgctaagtgctagtggagcccagatgagaagatctatgcatcttggaatagcctgcaaactcttagggagggcaatggcttccagctgagtcttgaggaatgggctcagtttctatgacctcagcctgggcaagctacaaaagcgcgtgaagtgtgatgggcaggtatcaagagaggaaatctgtggtctgggactctcccagtgaaatgactggatacccagctcctccccagccaggagaacttggcccacaaatccctgtggatgctacttaccttgagccctcctggctttcctgggttatgtttctttcctgatctgctttccgtaggggcaggtgaccttctaatatcttccactcaaggccagctcgtgttggccctctgccccttcttccgtctggtgttcttgttatcagaccccaaagtcatatgggctacctattttcagcacctctttctttcagccccctagtaatcatgagtccctctccagagaactctggacaagtcctggaggggctggaagtgcatctgagcagagcatccccacgagcttgatgggctcctcctttgttcccatccccagtcccaactatccagttctagccagacaccacagtctccccacaggttagttgtttctcctgagagcttttattagtcagaactcatagggttagaagagattaaaaaaaaaaaaaaaacctcattctaaactagatcttaaaagagaggaggcatttgttgaatcatgaaaccaaaacttataggggttcacatatggctgaatccaggtgatcccagatatccataggagtccgctatgctccatcaggcaccattctctcgggcactttcccccaagtggtagcaacaagtttacactctgtcagatagccacactgcctaagtcctagggaagaaataatagaatttcttctccatagtcctagggaagaaataatagaattgattgtggtttgtctttcttggaccattttatccaaccctgaatcatttcagccaaggaaatgagatactgttatggccaggactggtcacatgcccatctgtggaggtagagtcaggaagagtgggttccccaagtggaggatgtgggttttattaccagaagaaagaatgctgaccaggcacacatgggtgcccattgtggaagtgaaatggtggcccttgctcccaatggccatgggctgtatgtcccatcattgctgcccctactgccccatgggtaaggctgatgctgaaactcttgtccttacttacccttcagagatgctcagaggcaggtctgaaatttccagatgtttccacaagtttccaacagactatgttgggaaatctggaaaatactgttttcaaagatttggaagacctttagaagcctccattttcccctccttcctctatttttccctctgtggcaatagctgaccaaggaagctttggagatcccccaattcactgcttgtttctcattttgttgaccaacaccttggattcccaaataagaaaagcaatcaggaaggtttcagagtgatgtggaaagaggggcaaggagagggccaggcattttcatgcatagcatttgcacaaggacagagtgccaatctcccagcaaagttggcagacagggcctccagcagttagagtgacaaaaaggtaatcagaaccacttgccactttccattgagacagacatgggagccaaagtgggaacaattcctggatgataaattgtttcttgcttttcctttgaacttcaagatccatccccctgggtccctcccatctgatggattgactgacaagttcaatgggcaaggagaggattccatacccaagaatctgagctgtgttaaggcaagtctctgaagctaattgaatgcgaatgtcagctgccaccgataggggtaataggaagaaaagaattaccttcatcaggggaacttttaggggctgagagaaaaaccaagcagaataagcaaagcctcttgaacttcaatgtgacatttttgcagccccagcaaaagtcagttaaacgctagattttaactcttccttgaagaatgtattgcttttctgcaatcaagaaattaaagctagagcactataaatttttaattgacataactttgtatattcagcttcacatgctgatatttttatcatatcatgaacattgtaaaccaatgccatttttcaaaatcatcataaatgtctgtataattcagggaaaggatataccatgctgtatttaaacatttctcactctttggtcattttggatgtttccaatgtcttgtcattgtaaattgttccacctcacatttctgaggcagtgttgaatgaatgtttattcatttttgccagcattgaatattatttttaaaatctattgccaatttggtaggtaaatagcttctctctaattcacatatctttgactactcataaggataagtattactttgcatgtttattagtcatttgtatttcaacttctaaaaattctctttatgctcttcacacatttttcttcatagttcacaggaactctttatatgttaagtatattacaggccagacatggtggctcatgcctgtaatcccagcactttgggaggctgaggcaggcagatctcttgaccccaggatttcaagagagagcagcctggccaacatgacaaaatcctgtctctactaaaaatacaaaaattagctggacatgatggtgtgtacctgtaatcccagctactcaggtggccaaggcacgagaattgctttaaccaaggaggtggaggttgcagcgagccaagatcttgccactgcactctagtctgggtgacagagtgagactttgtcgctaaatgaataaatgttacaatttattctattagagttactgttaacatcttgttatttgtatttaaaacttttgtaaaagatacaacttagtatttttctaatattattaatgtattttttgaatagtaatacatttgcttggtttaagattaaacaggcactaaggagagcaaagtgtttcctctccagtcttgcccttttgtgactgaggtttcctcctgaaagcacccattattaccaatttttgtgtatatagtcagaactttcttctgcatattctgtatctacaaatttctacatttatttttttcatattccctttttatacaaatataatatttgtaatcttcaactttctttttctaacattttggagttcattttatatcagtacataaaagctttcttactctttttatgatgccatggtattctattgtatggtttattgtagttttatgacatataaaaaagttaaggactttacagtcagatctatctttccatttttaatttaatccattgattttatgcttaaaatatctttcactgtgcagtcacttaaatactcatctgtgttttcttttgtgtttaaactttgtattttaagataaaggtaaattcatctgcaattataagaaataagagatccctcacaccttctacctagtttctctcaatgtcttggaaaactatactaaaatattacagccagaatattgctattgatagttaaattgatcctcctgcctcagcctcctgatgtgtttactttttaaagcaactgtgaaactgttttccagagtggttgtaccatatcgcattcccactagcaatgtatgagggacacagttttctgcagccttgtcagcatctggtgttgtcactattttttgctttagacattctgatacgtgtatactgatactgcactgtggttccaatttgcacttccctaagggctaatgatattgaatgtcctgcatgtgcttacttaccatctacaattcctctttagtgaactgtctcttcacatctgctgttgtctaaatgtttgtcctcctaaaattgatatgatgtaatcctgacccccaaggtgatggcataaggagatggagctttgagtggtggttgggtaatgagggtagaagcctcatgaatggtattagtgccattgtaaaggagaccccagaggactccttctaacatgtgaggaaaccgccagaagacggcactctgtgaaccaggaagtgggccctcactagacaccaaatctcttggcaccttgatcttggacttcctagtctccagaaccttaagaaataaatttctgttgtttataaaccacccaaccgatggcatttttaacagcggtctgaacagacaatgactgtcttttgcccattttctaattgaattatttctttttttactgttgaattttgagagttgtttatatattctaggtgttagtcctttgttggatatgtggtctgaaaatattttctctcagttggttgcttatctttttctcctcttaacagggtctatcacagagcaaaagttttaaattttgacaaagtgcggtttatcagttcttttttggattgtgcttttgatatcaaggctaagcctagccaggtgtgatggctcacacctgtaattacagcacttgaggagtctgaggcaggcagatcacttgagcccaggaattcgagaccagcctggccaacatggcaaaaccccatctctactaaaaatataaaaattagccagccatggtggtgtgcacctgtaatcccagctacttgggaggctgaggcatgagaattgtttgatcccaggaggtggaggctgcagtgagccaagattgcaccactgcacttcagcctgggcaacagagcaagattctgtcaccaaaacaagaaaactaaactaaaactaagcctagccctcagtcctgaacattttttaaattttttttctaaaattttacagaaatttagttttatatgcaagtctgtgatccattttgagttaatttcacataagggtgtgagatttaggccaaggtttttgttgttgttttttggcctccgatgtccagttgcttcaataccatttgttgaaaaggctatcttttctccacttaattgtttggcatgcttatcaaaaatcggttgtgcatatttgtttgaatttgttttccttattttgttttattgatctatatgactatacctctaccaataccacattcttgattattttagctatataagtctcaaaatgaggtagacaaattcctcccatttttttttttcaaaactgtttttggggctgggcaaggtggctcacacctgtaatcccagcactttgggaggctgaggtggggggtatcacttgagctcaggagttcgagaccagcctgggcaacacggtgaaaccccatctctacaaaaaatacaaaaattaaccaggtgtcgtggcacacacctgtaggcccagctactttggagactgaggtgggaggattgcttgagccttggaggtggaggttgcagtgagccaagattgtgccattgcactccagcctgggccctgtctcagaaaaaaaaaaattattcttgatattctagttcctttgcctttcaatataaatattagaataaccttatctatatcaacaacaactcttatgtggattttgaaaggaattgtattaaatctgtatatcaatttgaggagaattgacagctgtactatattgagtcttataatttatgaacatgtaagtctctgtttatttagatatttgatttctttcaacagcgttgtatagtttttagtgtataagacatatatgatttgttggatttatatataaatattttctttgagtgactgactgtaagtggcattgtcttttaatgttggtttccatatgttcattatgatcatgtagaaatgcagtactttttttgtgttgaccttgtatcctgtaaccttattgaactcacttattctagattttttttggtaagattccttgggattttctacataaactatcatgccatctgcaaataggggcagttttacttcttcattttcaatccgtatgccttttatttcccttttttgtctgttgccctggctagacctatcagtactatgttgagtaacagtggtgacaaagacattcttgccttgttccctattttaaagggaaagcattgaggctttcattaagtgtaacgttaactgtagggtttttgtagattatcattatcaagttaaagaaactcccctctatttctatttttctagagtttttttttttttttttataaatgggtgttggattttgtcagttgctttttctgtagcaattgatatgatcacacgatttttcttgagcttgtcgatgtggtagattacattgattttatttatttttctcaaatattgcatcagccttgcatcccttgaaaaacgcttactgctcatgatgcacaattcttctaatatattgttaaatactatttactgatactttgttaaagaactttatatacacaatccacattggtttttagttatattttttgtattgtctttgattttggtgttagcataaaaccaacaacataaaatgaactgggaagtattctcctcttttctggaatagattgtatagaattgctgatagattttttaaaaatatttggtagaattctctagtgaaaccatctggacttgtggattttggtggggggagattttttaaattgcaaatttaatttccttaatagttacagggctattcaaataatctggtttatcttggatgagtagtggtggtttgtgtttctttagaaacactagtattttctttgagtgactgttaagtgtgtttctaaatagacttaaccactattcactccagatgaactagattgtttgattagccctaagctattaaggaaattgaatttgtaatttaaagtacatctattttatctaagttatcaaatatattgtgtagatttgtttatagtctcttttaatatcttcaaggtctgtagtaacactccatgtttcacttgtgatattaataatttgtgtcctcactatttctttgttcatcttgctagaaatgtttcaagttcatcaatcttttcaaagaaacagctatttttaaaatttcaatttcattaatttcctatttctttccttctgcttgctttgggtttattttgccctttcatggtttttttctctcttcttttttaagttcttgagggtggaagcctagattattgatttgagactcttcctcttttctaaacatatgctttcagtactataagtttttccttctcagtactctttagctgtgtcccacaaattttgatctttttttttttcattttcatgcagtacaatcagtgtatttttaacattcctcttaagacttcctctttgattcatggattatttagaagtatgttgcttagtttccaagtgtttgaaaagtttgttattgatttctagtttaatttcattgtggtcagagaaacacactgtataatttagattcttttaaatttgttaagatttgtttttgggcctgtaatagggactgttcttggtatacgttctgtgggaacttgaaaagaaagcgtatttttctgttgctgtgtggagtgttttataaattttgattaaatcctgttggttgatggtgcttttcagttcttttacattcttgctgatgttatgactagttctactaattgctgagaaaggggtgttgaagttccaactataagactatggatgtgtctgtttctactttcagttcacatattttgctaccttctggtcttaggcagaaaattcaaccttattaggagatggtctgctagacctcgttgactaaaaattgagtttttattctatttcttatattttattatatatttttaattttatttcaaagagcaaacaaatgtcttttggagtctgttgacaaattatataattttctcctctgacttatccttaaatgtttcttcaacatgaagtacattgtatttcttaattattcttagatgtttacctcagggttccaagaggaaaatgaggtggctgagctctctgtgaagagacctaagggttatgtgatattgagataatttgttgtaaaatgcctaaagtttcagtcttctgaaacattggcttcattcattttaggtaaaaaatactgacttctgttaaaattcagagcttttgaaaattgtgagctctatgagaggtagtgttggcaaaatgattacaagtatgggctttagaggcaaagttcgggcttcctagttacacttgttacctgtgtaactttaggatggtatgtaaagtctctaatagtttcttcatctttgaaatgggattgaaatctctcaggattgttttaagaatcaaatggataactagtgccttgcattcactatatgtttgcatctcagttggattaagggatggagccaatgagtttgggattggctttatctctagtgtgagggttttcccaggatgggaaccatttcccgttttcctttcgtttgacaaaactgtattctgtaagtcacagggacattagcaggaaagtgccggtggctgagagtagtcagttgactttatcaacacatgtttctgttcttaggtcagaaacatcatctttagaaagtgaaaatatgtttacttgcacacttttatttatatgctaatcacacttactggccatggtacaataagtgtgtaccttacttatggagaggttccaccatatcccaagccaggtattagaaccaaaagcactgtgtggtatccaaatccagctttacaattattccttctgtttagacatgttaaaaattaactacaggctgggcatggtggctcattcctgtaatcccagcactttgggaggccaaggtgggtggatcacaaagtcgagagttcaagagcagcctggtcaacttggtgaaaccctaactctgctaaaattataaaaatttgccgggtgtggtggtgcatgcctgtaatcccagctattcaggaggctgaggcaggagaatcgcttgaacccaggaggcagatgttgcagtgagcagagatcatgccattacactccattctggcaacagagtgggactctgtctcaaaaaaaaaaaacaaaaaaaaaaacaccaaaaaaaaacaacaaaaaaactgcaacactgacttctcttttgtggtagtataaagattaaaaaaaaaaaagcattactgtgtctttagtaaagaaggggcacaaaaggtatcactgattgggaaaaacctgtgaggcaaagcagtttttatgaactcactgaatatcttagttgtccagtgactttctttctgcgggctttattttgttaaatcattttgatttaaccaggaaaccagagcaagaaaggctagttagcaagaaacgattcagtcctctattaggtatttgtttccatttgacacatagtcaggagtcttcacagggctatgggggaacgatagtgactttttttttttttttggaagagaatgatcttggttaaatttagcaaaactcttagtaggtctggggttccagaaaccatgtgatggctctgcaaggccttgcagatgcttttaaatattatttgggaacaaaaatgttccctttggctggtgcccttgttatgttttctcatgtcccttccctacatttctctattgctctccatgtcaaagaccaagaatctagaatccaacatgtggggcaggcactgaacccccatcccctagcatttgactcccaatattcctggggaaatgaggtttgggtcaatgcggagtgaggcccttagtttcacaggcaagatagactgactcttagacaaattggagggagccggtagaaatataaagaaaccaatttgatcttcagggccaccctctgcaggggaagaattatcaccttcaagaagcttttattcagtggctaatgaagtatggtgctcttggggcccatctttcagggcgagtgattcattttataactagttatctaaataagaatgcgtgtggcatgaactccagttttactgaatctttctatgactgtggtgttgtttactgcagatgtttcaaaaaaaaaagaattcaaactagttcaggcagatggcccggtggttgggagacaaagtgctgattggcagtcccagctgctgctgtcggagtcacctggcagacctctgagggggtgattaagtgacaggtgtgctggggatgtggccagccgtctgtcctcaggtccttttagacaccatctgcaggtggccacgtctgggctgtgagtcaaagctacaggtgatccgtgagaaggaggaagtgggtttggcgctgtgcgatcacctccatatgcttgcggggaagacacatgcagggaagaggctgggctatagattacaaacaaaaccatcttcttgcatgagaaacagagactgcagtgttaaagatcctccgtgagctgctgtttcaattcatgattacatgggggaaggacttggataatgtaattcttaagtgatttgcaatgtgcctttcaggcaggttttatttacaattctacatgaagcctgctctcagtggctgggagaaggccagatgagtgtttgctggctccattctccagcttagactagagctggggatgaacaatgcagatcaagtggcaggacttggccagcccactctccagccttacagagccacagagcccaggggattcttagcggagtaaggtcaaggtgcctgtctcagtggagtaaggtcaaggtgcctgagcagcctgaggcctagaagtcacctggctgggatgcccagcagggagagcactgtgacctgcagacagtgcctgcctgcctctgcccagccaagccaggtccccaaaccagcctcaccctccttccaaccccttttttacctcactacctacagcagtacttttcaatctgcaggttgcaacccatttgtgacttgtgaccttcacttagtgattcacaacaagcattggaaaaaaatagaattgaatagagagaattagatttctttctttcttttttttttttttttttttttggagatagggttttgctctgttgcctaggttgcagtgacactatcacagctcattgcagccttaaactctaaggctcatgatcccaagtggctggaactacaagtacctgccaccatacccagctaattatttaaattactttttttgttgtttgtttagaggtaggatcttgctatgttgcccaggctggtctcacactcctgacctcaagtgatcctccttcctcagccttccaaagtgctgggattacaggcttgagccacctcacaagtagtacctactgtttcatgaaatgtattccaagtgtgccgtgtgtttgtttgctgggtgatactgtaaaatatatcccttactgtgggtcaaaacgtttaaagctgctagacatttctgttagcaaacactccttcctaagtgagatccccccaacaaatacacatatccctcaaaaaaaaaaaaaagtgccaaagctgggcacatttaatctaacttaaaatagactcttgtaagaactctggccaacctgccaattgaggttaatgtctttagggtgccctctgaattcagaagtgctgagtgcttcttacggagaatgatgggagaagggggagtctcagggacatttcagttattggtttgtaaaaaagcatcccaaaacttagtggctaattaagaatgggttccttttatgatgcttgtgaactatatgggttgagattgaagaggggcatggcagggatgacctgactgctctgtgacgtctgaggcctcaggaagatttggtggctggaggcgacttggcctctgagggctagaatcactgggaggcgctcacaggtctagcagttaatgttccttgtcagggacacttcagctgaggctgcagccacagcacagcaatgtcctctccatgagcctgggattcttcacactgtgacctccaggtacacagcccaggattccaagagaatcaggtgagaactatgtggtccctttgggaccttgcctcacaggtagcttctgctgctttctaacgacttcagaggagcccttgagagaaaagacatagaccacacctttctagggagggaaagtcaaagaatttcataagttgctgcaggtaggaagttttttgaggggtggggtagggatttgaattttagtggcctttggaggacaggttgcagttgaacgtggtgggacagtacccatgcggcagagaccagtgggcacgtgacctggcctgtggtgcagaagaaaagggatgtggatccaggcctttatggaggctctgggggcagagtgctgcaatgagtcctgagaacaatgtatgcgtgaagtcttagaggagcagcatccccgaaaggcctgcgtgttcctctctcaggcaaacagatggtcagaaagcaatagctaattattagacagatgagtgaacacccatgcttgaagattacctgagtgctagccaccgaatattcagaacaaagaggaagcttctgaagccagaaatggtacagtcactcccataactcccttactagaaaagcctggagaggtacccagagggcagggaggttgaaagggaaggaaggctagcaagatctctgcccctttctgtacccaccctgagtccccaaggttctgtctgaaagggagggctggccaagtctccagttctttcaggggaaaaaaaaaaaacgtagttacatttccaaagggaagatgaaaggaaggaaagagaactcacttctagaggcttctaagaaaaaaacaccgtttcgaaaagcaggcaggatcggatgcaaatgaggctttcagaggcaatttggtagaaaatgggatgtctattagacgattaccagtgttcgctcccccaaactggaataagcctcttgatttgtctgcattcatttggataacctacaaaatcttgtttatggacttttaacagtgagagagagcatttctggagacactgatttccacagatctcagaacctcctcaaaaacctgagcacgggggaaggggaggccatgggctctcctgccccccaccatcagggctgtgtggtgggccagaaggccattcatggaggtctcaaaatacaccaaatgtttttgcactgctttggttgacattctttacgtgggagcccctggtatattaaatagtaagccccacactccctcaacctcacagaggtgtctcatggattaaggatttaggacaacaatccctactgcacccgcccctttaccgttccactgcttttcccgtaacaacttgggggctctctgtgggcccttgaagcagtcacattgctgccgtccccagctagggtcataggagtccctgtcccccaggcctttccctaaacccctattctagcttctggactctcctcaggtccttggagaagagtcacctcctgcccacaaggtgtccctctgccagtcccagtccttgagcccttccacatgcatcagagtttagggattcatttctttcccatccccttccgtcccctccccgcttctcccgtgactgatgtgagttgccctcgcacacattttccaaactctccaaaaagcagctttctctgcgcgcatctgtgtgtgcggacggggcctggacttcgaaccgccggcgcggctccacgggctccctgctccggccgcccccgggatgcgtgttgtaggcactggcgtggggaggtcagctggtgctcgaggtggccagtggagtggacgggcaaggggggcgcagtttgcgaactgctggggttctcggagggccggacagcccggtgttttctaataactccctcctgccgcttcagatttggaaacgcatttcggggcgtgatcacgcagctgcctcttggcattctggtgtccctcgaggtgaaggcccctgggttgggcttatgttgttgttatcgtggggtacccgagggggccaaagagagaaatcaacacccagtgatcgggcttctcgaagcatccccggttttttttttttttttttttttttaatgccccactcagagtgaccagtggcaccgcagaaagttcattaacactcccatttgtggcgtctgattcacggctgctgccgctggtgggaagctgggagctgctgctgcgagagcaaatcagcttgggctaatgcatatgttaataacgctaatgttggagcatttggtgttcctcaaagaaagacggtaaagtatctgcgctgtctcctccaacgcttaataaggcgggtggcggggagaggggagcaacaaaaagccattcacttggagcatttatagttagcatttatagaggagagcagcctgtcggtgattctgaaggcaccatgccaccactcagccctgcgccttgcattgttcagcaactccattgtaaaacggtctggtgacaggcgcgctccagcttctgagtttggaaaggcaaggcgtgctggctgaccaaacggttcccttgctagcctctcttccttaggaggaatttgctgtaccatctgttgtctgcgtgtttgctggtgtccctgaggatgtacccaaatgagacacccttggggccttccctggcaatccttcctgacatcaatttagcaacatcaactcccactttcctggatagagatgggttaggatgtatccacagcagagctgctgaattcaggcctggcaggcatcacattttatttttaaaccacaaggtgatagtctttaagcttataattagagatattctagaggaattcactcagacacttactgcgtggtgcacagtttgctgggtcttcaaaagaatatggtgctgtctgagattgtagatatgtgcccaccatatgggattctcgatgtctttcttcatgtacctggtttcaaatgactctcagcaatatctccaacttcttcaggaaatggagatagtttagttctttaggttttctttcaggttgatgtccatcagaaaatatctctgatgtaataagtgggctgcaatggaaagtaggattttaaaatttgggtatctctcatactgtatcaagagtttatatgttcaatctggttttctgcttgtcagcattaaaagactgaaaatatgtttccacagttaaaatttgtaaaggtcttgcggtaaagactgcattgaaaagctttggttccagagagattaggacggtccgggatgattctgatctgtggtgattgctgtggcatttcaccagcattgtatctgctggaagtgggagctgtcaagtctttcagtgaagttgtgcagtttaaaaaaagtatctccaaacaaacaaaagcatagaaaccaaggttctacagcacattaggagatctgtggctctttcgccatttctccagttattttttagattactctctgtcataataggccaagaaccaggatactgttaaagaacaactgcctcttggagctggggccagtgttagtgttaaggtccttcataagaagtgtatatttgttgttacttggctttggactatagtgaaatactttttaaaatgggagtgtctttgctttcttgattaggtcttttcttttttctttttcttttcttttgagatggagtcttgctctatcggccaggctggaatgcggtagtgcgatctcagctcactgcaacctctgcctcctgggtttttaagcagctctctctgcctcagcctcccgagtagctgggattacaggcacccaccaccacaccctgctaatttttgtatttttagtagagatggggtttcgccatgttggccaggctggtcttgaactactgacctcaggtgatccacccgcctcagcctcccaaagtgctgtgattacaggcatgagccactgcgcccagcctagatttgtctttaatatatgttaaagtaagttatttttccatggccatgtactttctggtgatggaacagagagggcagtctattatgaacatgaggagttgactggaataatgaatgaaaaccagctttaaggttcatgagtttcatggtaagggtgctgaggtgtcttacttgggccttcagtatgggtataactcatggagtataggatcttgacatcctattgcagactagaaggttcagcctggaaagagactgaaggtgagaggaggtggaaaagaagggaaaaggtgtttgcgattgtgatggagaaggtcctggagttaaaaaaggcaggcagtggctagcaatgtatgggttaaagacctgtagcactggtccagctctcctctgtacccctttagtgagagggaggttctcttcgcacttgcaccttctcccttctcagcagaagtaagagctctgtatcccttggtgggagggaaggatggccaagggtcttagttattgcaagataaactatcccaacacttactggtttaaaccactaccaatttattatgctcatcatttctgtgggttaaggcagggcacagtgagaatgtcttgtttctgctttgtgatgtctagaatctcagctaagaaaacatggaggctgggggctgacttgatggctgggagcctagaattatctggaggctgcttcactctgtgtgtggggcctgggctgctgggatttctgggagaggagaccgaagactgcttgtcattttccttccttgaagcatggtggcattgggaagtcagaattgaaagtctgcttacctggaagctcagggcttcaagcttgaatgttccagtgaacaaggaagaagctgcatcttttcagacctggtgccagaggtcacacactgtcaccactatcacatgctattcatagaaccagtcccaagtccactgtgatgagcagaggaggactggactccaccccttcaatgcaagtgtgtcaaacacacattgtagaagaggctgtgggatgagagatgtttttgcagaaacctttggaatcagcctcaaatggggagatagagaaaccaagcagaaagggtctgagggcaaactgggcctgctcttgctctgatctccccttagaacagctctaacttagactctgcaaatgcctaaacaactggttggtcaagttgatcatatttttaaaaacccatcagattaactatttggggttgtgtaagccaaagacaaatgggctgactgagagctttttcactgttccaagattgttatgtaggtccaggcaaagaatcgtgggacccatgtctgcaacaaaagcttggaggcagcctttctggccatgtccccccctccccattgcccctctgccttcttggttactaagcagttacctggcaaccatgcctcctccacatcggctgccgagccaagaggcttagcctgtcctccctcagctctcaagtctcccatggatcactggggacaggatacataatgagattttaattgtcacgttgaatcaaatcattttttccatgtgcataacttctaggcagagatgtaatttcaattaacttcgcttatctgataaaactttcatatcctttaagctaatttcatttgaactaataggcactatgctcctctttgagttccagctcagatgtcttaggcagagccgagatctcctgcatactcgggcacattagagagcgtctgggctgtgtgtgcagaagtggcctctatgcttggacacagctagtttatggagcctttccttttgcttttctcacttgatgaacattcctgaaagcctatttggttttattagttttcagcttaagggatcagtatttcccaaacaaaaggtgtcccattgctctaactgccagagccataaagattaaaattacacttaacttgaaggaatgtctgtatttctccctgctgctacaggacctggggcagctggttctatctcagtgatgagtttgagcatttgttttattaagggaagggggaaggtgagaaaggcattgtaatttaatatgtgggagaaaagggctgatgtgccttaattttatttctcagtaacccccatgaatgtgctagttctgcttaaagttcatttgaacaaaaacatgcctttgcagaaattaagctgctctcattatttcttttcatatagtagaattaaacttcaaacagtttatcatttgttctttgacataatactgagtttggccaaaaccaaataacttgatgctattgagcaacagaaattcaaatgcaaagatgctgcaaggtaatgtttaaacaaaccacacactggtcaatttttggatttcactgctagcattttctggctagcaagtttgtttcttatcaaatcaagaagagaaatctaaggaatgagaatgagagagaaaggtttagtcagaaggagaaaacacagtgaggttgaagatacacacacacatgcttacatgtgcacattcacacagatgatggctaggtcctcagaggatcagccctgagcttctagcccagagtgtcactggtttcctgtgtgaccttagacaagcactcagcccctgtttctacatgagtggaatgaggagtggactaggcgcaagacctatggtgggctgaggcttactagtatttgattcaaagccaagcagatggggttgcattgagaccacaagggtaggcactgagtttgggacttgccaaagaagagaagattaagagactgtaaaaagagtcacttgctttaacagtggcactcaagcctaagcactgttcctcatccttactgtcagcatgatgagtttgggtctgtctttcagggatggactcccaccaaccacctgggaagactgatatattgtggtggttaatattgagtgtcaacttgactggattgaaggatgcaaagtattgttcgtgtgtgtgtgtgtgtgtgtgtgtgtgtgtgtgtcttgttaaaggagattaacatttgaattggtggactgggagagacagacccaccctcaacctgggtgggcaccatctaatcagctgccagcacagctaggataaaaacagaggaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaacaaaaaaaaacagaggaacattgtaggactagaccagcggagtcttctggcctccatctttctcccatgctggatgcttcctgcccttgaacactggactccaagttcttcagtttttggtctcctggacttacaccagtggtttgccagggactcttgggccacggactgaaagctgcactgtcagcttccctacttttgaggtttggggacttggactggcttccttgctcctcagcttgcagagggcctattgtgggacttcaccttgtgatcgtgtgagtcagtactccttaataaactccctttcatgtatacatctatcctattagctttgtccctctagagaacactgagtaatacagatttaaaaactcaagtgccaatgtgacaatttatggtggaattgtaaaacgagaaacacatctattatgcagatcccagtgtttgtagccaaagatcaacatcacaatggataagctgcaggaaaggacatgttggtagtttccagtttggggaaattatgaaataaaactgatttaaaaaaaaccatgtacaagctttcgtgtgaacatggctttgaattcacttgggttaatggctagaagtgggattgctgtgttgtatggtacatatatggccagtgtgtgtttggtgtatggtcaaattgtcttccgagtagctatgccatttttcattcccatcaacaatgaataagaaccaaattataattatatttccttggtaaacagggtctttttcatttgtgcaataaatagttattgagaattcattaaatgccaagtggtattctagacattaagagcaaaatagacaaaaatccctgtcatcatggagtttattgtcagttggtggaggaaggataagaaaataaacaagtgccacgtatgtagcatcccaaatggcaatcagtactaaagagaaagatcaaacatgggagtgaaactgtagagagtgtgtcggcaagggtgcactgagacagtgacatttgagcaaagacctgaaggaggtgaggaagtaagccctgagggtacctaggggaagagaattccaggtagaaggcacagaaggtccaaaagtcctaggataggtgcatacctggtatgtcaagtaaggctggtgtggttgagcagagtcagggagaatggggtagtaggaaatgaggtcagggaaaaaagtggtggctgagggtgaccaggtcttggagaaccacagtaaagacttcatctttttcttggagctggatgcagagccattgggagggcttgagctgaggagtgacatgatctgatctgactgagcctttgaaaggatcactctggatgctgtgttgggtagcagagactaaagggtcagagagaaagaaaggagggtaattagaaagctaacgcagtaatccaagggagagacctgtggcttagaccaggaggtggcaggaagtgattggatgctaaaactaatgttagactggagccagcagaatttcttggattgattggatgcagaatgtgagagatatagaagtcaccaggtacctggggttgggccagaccctacagatgaaggagttagtcctctataagactatcctcacttgagacagcagctataaattcaagagtcccagggccaccttcacttctaaccagctggctacacatttaggtttgatgaccacgaccaccctcaggtttcgtaattcaccagcaagacccacagaattcactgaaagcgctatacttaagattacagttttattacagcaaaaggatacaaattagaagaattgcatggggtaaaatctgagagtttcaagtgcaaagcttccatccttagggacacattgctctctcaacacaatatatgacaacactccaagggtcgtggcaactggggaagctcacctaagcttcagtggccagtgttcactggcatttcactacataagcctgattgattgaatcatagcccaggtcttcagctcccctcctctccctcctagaggtcaggcagatatcatgtgtgccgaagtcccaaccccctaatcacatggttggtttttctggtgtgacttgccctatcttgagctatctcattagcaacaactatgtagggacccaccatgagtcacttcattggcatacattatcagacatggtctgagaggctcagcatgaaaacaaagacattgctctctcttcagaaattcaagggcttataggttaactcctaggagctgaggagaagagccagccaagttctttactacacataggataacttagaagattttgacctgaacaaatggaaagatggggttgtcatgaactgtgctgaggaaggaaacagcaggcttggggagcctgggagtgtatttggatatgctcagtttgatgtgattttttttttctgtcacctaagcagagatgcaagtagacagttggtgttcagggacaggtcctggttggaggatgaaaacttcaagaaagagatgggattcacattagagagatatttgaggctgcaagtcctgagaccttgtggcactggaggaaagaagcgctctccatctggctctttgggcagctcatctctgtcctccagtttaatcattccttgctggtcacccatcgttgcctagaaactcattcctcccatcccgcctccctgatattttgtccaggtcactttgactggaggtccaagtgttgccaaattctttagtcaaatctttacaggtaatctctgggttgattgtcacagaagtggaaaattacagccaggatgggtgactttacaatgtgaacaatcagacagtgaccttctgccttgcactaccttatcactgggggacccgtcatacccaccccattctgccttcaaactcctcataaccaggggtggggagcaggggtcaagtgaccctgggaaggcatttgagtcttctggggctgttagacaccattcattaaaaggaaacattggacttgacgctttcctgggtcttttttggctaaaatgatctctcagtctaaagagtcttgtatgctggttgtatatgtgtatgtgaatgtgcctgtgcatgtcttgcctcctcaatagatagtaaaatttttatgcagggatgttaaaggatcctagagcagtttagaactgattttgcttggtcccatctagtatttctttcctatccctctgggcgtagaaattgacacatagtaaatgttcactaaatttttaatagtagtgaattgaaacagttattcagaaaatttaaatcccttccctgcctcccacccaaaccaaactaaacacttttatctgtgagttcagagtgttttagatcctgagtaatctgtttaatagcatcagttttcacctttactctggagagatggggagagagacaccgagatacctcttaaagacagaatagaaaggtggcttctggggtcagtgtctggttgggttttattccaaatccaccatttactaactctcttgggagagttacttcgccactctatgctttggtttcttcatctgtaaaatgaatctaataatggtacttatctcatagggttgatctgaggattaaacagtttaatattggtgaagcacttgaaatactgtgtggctataatgaaggctatgtaagtggaggtggtcttgggtatttagaggtgaattgatttgttgttgttgtttcctttttttgagacagagtttcactcttattgctcaggctggagtgcaatggtgcaattttggcttactgcagcctccgccgcacaggcttaagcaattctcctgcctcagcctcctgagtagctggacttaccggcgtacgctaccatgcctggctaatttttatatttttagtagagatgggggtttcaccatgttggccaggctggtcttgaactcctgacctcatgatctgcccacctgcctcggcctcccaaaccactgggattataggtgtgagccaccgtgcctggcctttttttcagaataacattaggactggccaggtgggcggtaatacttgtagcacatacctcatgcagttagtttgcactccaagctaaggttaccatgggcctaattttgtttttttcaagtgggaaatgagttcgctgtcttcgaagttgtaacctacaagtccttgtcctgtgtggcctggtgacctagttggaggtgtgtagaagacctgggggaacagatcagcacccccacatccccaccactggagacgactcagagttcattttctgctgatcatgggttcaattccttttctttaggcatggaaggtgacttattttattatggaataattctgtgttgggggagagtggggaacttgttcagtatccagaagcatttacccttcattctggctcagtcatcataatgtgccattttttgttgtgatcaaagtgtgtttctgttcctgccaagcccctgtgtcatgagaaccagcgcagcagctccaattttactgctgaggaataaaccaccaaagcaggtttctaatgaaagtgctagggagactttaattataaccgtgctcttgagctcccttggcaacaccttctcttttgattcttttcagagtagaaacaaaaatggagctgctggtaagagctcatgtcagggagccttagtgagctgggactctttagtgtagccagctctcccccacccttatggaaaagcagttcctcccagatcacctgagccccactggctctccaagctggcctgcaccccagcacagtgcagggaagaacatcttcagggtgctagtggccgattgcatgcggaaggaaagagaccaagcttaaagaaaatcctgggtttattgcccccactgagatttttttaaaattgactacaaagtgctgttgtctgggctctttggaacaggttgcatgtgtttgttcaattgcattagtttttgctctgaaaattcccttccttttctctcctctcagtggcccatgtctaggggctttgttttccttactccccttttccttttctctctctttgttttgcaatgcctccagcacatagtaagtgctcaataaatggtgttcttcctcttctttcacctggatctattctgagtttacttgctttctctttgtttttgtgcccttatctttctccctgccttcgtcccttcccccagccacctgcatgctcttcatcagtctgattcctttccccagtcccattctccttcctgccttgtgtctctttttttcattcaccttcctttgatttaaatcccaatctgaaattcttctttcctcccctccttctcccaatctttatttttcaactctttgtctctcatgtggcctctacctctatttttccactgtccctttgcccaaatgcttcttagccttggcttggaacattatatcacccgagaagttttaaaaacatcccaatgaccaaactgaaccctagacaaattaaatcaggatctctgggaatggaacttcggtagaaatgtttctaaaaagatcccctgttgatttccatgtatatcccaggttgagaaccattgcctggctttttgattgaacatgtttgttgtgcaaagccaactttatattgctgtggctatctctaggtggcttaactgatgtttccgtttttcatttagtggaaagcattttccttgtgtcagttcccagtgtgggtcctgtgacctttgttcttcctcaaggccataaagagtccaggtcaaaaatgaaggagaggtgaggacaggagtagcatggggaactgggatgggatctaagctaccctaaatgcagagagacagtaaaggcacagccaaggactggagcttccagtttctagacacccaagtggaaagctggcttgggttggggtcaggctatgtggaaagggtaagtgcccctgatccaggcagctctgcttacattggcttccagaacatcagcttcccagcctgggcagcaagaacagtgctagcttctaaacttctgcaaaccctttcttctgagcttctccctggctctggatttcaccacctcattctctgtcaggcatgttgggatgatgcactggggactctggagcaggctgttccttgacagtctcttcactgaacacagagtaaggaatttacttcatgtaggggacacctcagaagcaaatcaaacacctgctcagtggactctaaaatttctagcacttgtcaagtagagaaggaagcagcagatccagaagcactcttggaagccctgcctcacattctgcagtttttaccaggcttaacctggaatgagccctgctaaacactgtaaagccataggcatttggcatgtagtctcaccattgtataatatatgtgttcatggaccatttataaatcagctgaagaatatctgataggggaacccaagtcaaacaggcaatatgaaaatgatgatgaaaatttaccaggttctaggggtagggaagtccaaacactattgacccactaggcagaaattcaaagtccaggagagagaatctgcttgccccatagtgggtcacacagggtctcctgatcccatacccaaagtctagtacccatgcatagtgatcatctctggctccttgactttgtcattctgtgctgagaagtgctgaaccagcacagccacattgagctcagctaatccatcagtagctgtttgttcctgagactgaccagctgcaagtcggggccacagaaaatgcagggctggcttctcaaagcaagggcagcctgatttgctgcaccctggcctccagctcaaaggcaggaggataagttggtggcagctccttctgaggctgagaattggctctccttgcaggaattggatcttatatttagttagtatctaggcactggctgctacatacagattggtttaaagcctcttacttaagaactttatttccgggtatttgttaaaccagtttcaactgagagtaacctagggaagcctatggctctcaatttgagttggataagaatcaccaagggatttttttttttttaagataatgatgcccatgtccaaagcttctgatttggctggtctaaggtgaactttttttttttttttttttttaagcaatggggttttttgttgttgttgttgtttaaggctcccaattctaatgctactcagggataagaacaccagtagagtgaaaagcccatggagaggccaggacaactgaattccttgttctagagtttaggtttgccacttcctagatgtggcactggggaaaggctatgctgctcctttaaaatgtgaagggcaggctagatggaaaagttccacaagcatcccagtccaccagggagcctagaaattctacagaagctctgaattccacactaggcagactaaaatccacaccagcatcctagaggcactgggcagtcaatctcggagatccctctgagctagaaagtctagggccctgtgaccttatgtgagcagcaccatgacatgtaacaaggtccctgtcctcaaagcatcgagaatgtaattggcacaggtcaggcacatggagagcatccaggcacgagaaagaaagggatgagctgctggaaaatgatgtagcagggaaataaaacagcagcaacaacaacaaaaaccatcaaggttagttgacaaggaggcaggaagggggtggaggtgcggtggtggtgatctccaaactgttttcatgcctgtgtgaaatggtttatgtgttctctactttaaccaggagctctcaagggtctaagttataaagggggtggaggaagcggctcctgctgggcagataatccaggcacgagaggattatatttttaacaactttccagcgggaggttatggattttcttctctttgggactcttaaatatctttttaaaaagcaaagaaacatctatttgtctttcatatttcaaagatgcttctgctttcctataatcagaagagcatggtgatacctttgtttcgatgtgttttccagaagaggggtggggctggctttttgccctatcctgttctctctccgtctgcctttgcaacagtttttgaggcaactgaccgtggctagaggtggggtctgtagctgggagagaatttttctctgcacgaggtg

SEQ ID NO: 83 - DNA, 322743 bp, Homo sapiens
tagaagtttaaaaatagattatgtgtgacagagcatggaaaacaaagcgagagtgcatccgtactaaaaacaagatgattgatagacaggcaggcaggcaggcaaatatagaatgagccaggtgcagtgtctcacgcctgtaatagcagcagtgtgggcggctgaggcaggcaggtggattgcttgagaacaggagatagagaccagcctgggcaagatgatagaaccccgaaccccatctcactcacatatatacatacatacatacctacatacctacctacctacggaaaacatgagaaacaacataaaagtcaaccggtgttgtggtgcatgcctgtagtcccaagtaatggggatgggagagatcagaggcaggacaactgcttggtcggtccaaagcgttgaggctggggtgatcctgggcgacagagacagaggaagaccctgccagtaaggaaggaaagaaggaaagaaggaaggaaggaaggaaggaaggaaggaaggaaggaaggaaggaaggaaataagcaagcaagcaagcaaatgatgaacatgacaatgacatagaataacccatgacaataaacaagcaaataagagggtatgaataaagctaaaaggtaattaagatcacaatcaattgttttctccccaccccaccccactcctcctcaccccacctcaccccacctcacgtaagctggagtggaggtgcgcgatcacagcccacgttagcctctgcctcccgggcttaagagatccctgtagtcccagctacttgggaggctgtcaccagggcccagagtgagaagaccaggcaggcccaaaaaggaaagaaaataagcgaaaataaaaaataataaatgaaagaaggaaggaaggaaggaaggaaggatatacatacacatgtatatgtaaatgaaatgggttttcatttaatacatattcatacattaaaattaacatttataatataaacaagtattaattatggaaatatctatatagttttatcactacatatttatgtgtgtgtatgtatgtatgtgtgtatgtgtgtgtgtatatatatatataaatgtatgtttatacacaacagcgtgcagaaaataagattgaagaaaaaaaggaattggccgagcttggtggctcacgcctgtactactcccagcactatttgggaggccgaggcgggtggaaggtcaagagttcgagaccagcctggccaatatggtgaaattccatctttactcaaaatacaaaaattgctgttcgcttgaaccctggaggcagaggcagcggcagcagtgagaagagaaggcaccactgcactccagctccagcttcagcctgggcgtcagagcgagactccatccccagaaaaaggaaagaaagaaaggaaaaaaaaaaaacacacacaagacaaaaccaaaaaaaccaaaggaggaagtattactgactgacagcaacagtgactccctctgaaaagtacggcggaagcaaacaaagtgggcctgaaaaaaatgtaggagagggagttccacgtggtcccagctccaccaaaggctgaggctggtgagggccacccgcgcgtgaacggggataggtgccctcacatgggtgcgctgcaccatccagtgggaccgccactggccgcctgctggtcaatctgggacacaggaagccgccggctaagtccggagctcgctggcagcagctgatcgaccctggaggttccgactgagatgcggacgctccagatccggctcatcccaacaggcacccctgcacacctctcggtccagagggcctgccggtcgacctgggacatggctagctgccagctgtttcacaccctcaggcagcagctggtcgaccccagaggcccgaccgaggagcagccacaagtggaggttggccatgtgtggccaaattctgacccagaagcaggtcgtctacaaatggtttagcaccaggttccccacgaacgtgtgttgcatgacgggcaaggaggccacctttccagccacacccttcccaggaggaagggcactctgcaccggacccagtcctagcacatggtggggcacaccccaccaagggtgaggcagcccaccagcgggggtggggaaccggctagccaaggccagccaaggccagccaaggccaaccaaggctccacggtgctgctgtatccttccgcctgggcaggattctgacttagaggcgttcagtcacaatccaacagaccgtagcttcaccccattggctcctcaaccaagcacatgtctgaacttgccattcctctcatgctgagcaggattaccattgcaacaacacacatcacggagggtaaaactaacctgtctcactacgatctaaatccagctcacatgccctattagtgggtgaacaatccaatgcttggtgaattctacttcacaatgataggaagaaccaacattacaggatcaaaaaacatccctatgaatgcttggccgcaacgaaccagttatcccctgtggtaacttctgatacctcctgcttaaaaacgtcagaatgatcgtcaaagcccagctttcagtctgtattcgcactgaaaatcacgatcaagcgagcttttgcccttctgctccacaagaggtttctgtcctccctgagctctccttaggacacctgcattaccgtttgacaggtgtactatcccaaactccccacctggcactgtcctcgggacgggtcaacacccggccggcgtgcagctgggcacttggcgccagaagggagggcccctaggggctcaccccctgcctcaccaggtcagtgaaaaaacgatcagagtagtagtattccatgggcagcccacaggaccccaccccaccccctcacggggataggggggcactggggacctcccacttattctacacctctcatgtctcttcaccatgccagactacagtcaagctcaacaggttcttctttccccactgattccaccaaccccattcccttggctgtggtttcactggatagtaagtaggtagggacagtgggaatctcattcatccattcacgcacgtcactagttagatgacgaggcatttggctaccttaagagagccatagttacttccgccatttacccatacttcattgaatttcttcattttgacattcagagcactgggcagaaatcactttgcaacaccccccgagggccttcgcgatgctttgtttaaacagttggattcccctggtgcacacagttctataagtcggctgctaagcaccggcggaggtgctgcatggaaccgtggcccctgtggcggggaccagcccgcggcccgccacctccacggagggggggacaggagacagatggggctgcgggggaggtgggggaatgaaccaccccgcctgccacccactgacccaatcactccctgcccacgctgacacgcatgacagcgcagagcgagacaggacacaccagcacccactgggctccccatgggtggccacaactggggcaatccatgggaagggcccagcttgtgtccagagtcaccaccaccaccagcaccccctcacgggagatcatgccctgccactggggctgtatggccactgccacccctccgcccccacacaccacctccatagagggggaggacagagagagagggggcgggggagggagtgagcagcacacgggttggggcaggggagggccacaacaggcattcctggggcttggggggggcagcggggcctcgtcgagcggcggcacgcacccagcccaaccgacccagcccttacagccaatacttatcccgaagttatggatccggcttgaggacttcctttacctacattgttccaacatgccagagtctgctcatctcggagacctgctgcagacatgggtatggccctgcgtgagacttacaccgtctaccctggattttcaagggccagccagagctcaccagatgccaccagaaccacgatgctttccaaggtacagtcccctctctcggggcgaacccattccagggcgccctgcccttcacaaagaaaaagagaaccctccccagggctcccacatgcttctccagggtcagtcacattaccgcactggacgcctcatggtgcccatctccgccattctggattcggggatctgaacccaactccctttcaatcagctgagggcaacagaggacatcacccatcccttcggaatggcactcacccatctctcaggaccaaatgaaccatgttcaactgctgttcacctgggacccatgttcaactgctgttcacatggaacccttctccacttcggccttcaaagttctcatttgaaaatttgctactaccaccaagatctgcacctgtggcctatccacctgggcccataccctaggcttcaaagcttaccgcagcggccctcctactcctcccggcgtagactccgtggggctgcaggggaggggggggaggaggggacgggaggacccccactgcactcacacgggtgtactgcccctgccgctcccatccactctcaactgctgtcaacggccgggtatgggcccaacgctccagctccatccattctcaggagtagttgatttggcagctgagttgttacactccttagcggattccaacttccatggccaccatcctgctgtctatatcaaccaacaccttttctgaggtctgatgagcattggcatcgggcatcttaacccggcatttggttcatcccacagtgccagttctgcttaccaaaagtagcctacgaagcactcgcattccacgcctggctccacgtcagccagccaggcttcttacccatttaaagttacagaatagactgagatcgtttcggccccaagacctcttcccgctgaaatgtgggtgtagttggagagtagctgggacagacaggagggtccgtaagtggtgggggtgaagaggtgagagagactggtgagggtctcactgaggtctgtgagtttgtaggtgtttctggggtgtgagagaccgactcccgctgaaatctgggcatagttggagagtagctgggacagacaggagagtcattgatggctgggggtgagctgctggatgatggcagtaagaacatatggtatattattcatgaatgaggtgactgtgaagaatctccagaggaggacacgggagagcacaatgacatgagtgattgtcctgcttggctaggaaagggaaatgtaaagttatgaaattctgttgatgagggatgtgagagtggtgaagccctgcgggatgatgtagagtacttccacatccctggtgaggagctgcctcttgggtctgagtttctgggaggggagagggagaagctgggtgagacaggtatgaatcttgaggagtcagggctgggggactgctcatattctcccgagacttgtgagtctctgggggactcctgggtgcatggggctgactcccgcagaaacctctggatggctggagagtaactgggagacacaggagagtccctgaggcctgggggggaagagatgaaagacataggggaggagcaccacaaggctcgtgagtttgtaggcgattcctgggtgtggggggctgatgccagatgaaatctggggttgtttggagagtagctgggagacacgggagactccccgagagctgggggtgagctgctgggtgatggcagtaagaacatgtggtatattattgatgaacgtggtgactctaaagaatccccagaggaggacactggagaacccaatggcttcactgattgcccatcacggtgaagaaagggaaatgggagcttgtgggattctgctgatgacagaggtgagtgtggtgaagccctaggggatggtgaatggtagctccggatccctggtgaggagcttcctcttaagtctgagtttctgagaggggagagggaaaagctgggtgaagctagcatggctcttggggagtccgggctaggggaccattcataagaagagccagacaagatcctacttttcttaggtgcagacatgattaggaaacctgcagctcccggggacccctacaaattttctaacccgcagaatgaaggagtctgtgtgtatgtgtgtgtatgtgtgtgtgtggtgtgaggtatgtgctccttaagaaaatggaaataaaccaaccaatgagacagacagacagacacagattcacttagccaagtgttctgtcctgtcctctgaatccacttccaagtcacaagatgctgtaagctccaagtccacgcagagcccgcaaaacgctccggccgctgctacgctgggcgaagatctgagtacagccctgccagggtgggtttaaatagcctcgggcacagcctagcagcggaaagggcagagcttcactcttccttcctatcagtcacccccaactttcccaggctacacctagtaggaaactgttctcctgatttgatttcatgtgccacatttgggacaatctaagaatttacaagttttcttggccaaatacattatgaattaaatgcactgaaacactgaaaaccatctagtggttctgtggttctcacgctgtggttctgacaccagcagcatccttgcaaccctcaaaccccggagatccacagatttgtgttgtaacaagccctcccactgaccctgatgcatggcagtttaagaattacccgtgtaagcgaaaagactttgaagaaaaagtggagatatgcgttgtataaacttttttttgctctggaaccacatagagacttgggagccagttgggtggagcattcgttggatgagggtgcttgggttaggaatatcaaggtgtggctccagataattcaatcatctcattaagtttccagttatgctaatctgttttaaaattcagtttgtgtaaattcttttactcagactgagaatggcaaatcctcaaccccaatttccagggagggttgagagcctcaggttgagttgatcaccaatagcctatggtttaacccatcatgcctatagaatgaggtctccataaaaacccaaaaggactgggtttagagagcttctggataacacttcctggatggtagtgctcccctccccacatggtgggcccaaaatcttttttctgaattttttgcaatatccactataataaaatggtaaatggaagtctttccctgagtgccgtgagctcttccagcaaattaatgcaactaaaactgggagtggtggaaacctgatttatagccagttgctaagaagcacaggtaaaataacgtagggcttcccattgttgttagagtgggaggccagtcttgcgggactgagccctttggaatctcatgctatgtcccagtagatagcgtcatcattgaattagaagacacacatatgttgagaataatttttccagtcatttgctgtatgtcttatttacaatatgtaatcaaattcttcatcctgaccttatggcacctgggttgagaaccatgatttgaacaaaaaattggtctgtcactttctcagtttgaaactttattttgccactagcgttttgttatagttttttcgttttgttttgtttccttttgtttctaagttctggggtatatgtgcaggatgtgcagatttgttacaaaggtaaacgtgtgtcacggtagtttgctgaacctgtcaacccatcacctaggtattaagcccagcatgcattagctgtttttcttagtgctctgcctcccgaaaggccccagtgtgtgttattccccttcctgtgtccatgtgatctcctttttcagctcccattataagtgagaatgtggtgtttggttttcttttcctggattagtttgctgaagataatgacttcacatcaccagtgttttttttttttttaaagaacagtattttattgaataagatttattcacagaaaaataagctttaatctacaatgaatgccagactctaccgcagaaagcaattttctcagttttccacacacaaaggttcctactaagtgaaaaaagccataaaatttcattcacaaatgaactactctgtctcaaaacatttcccataatcattcattgtgctaaaacaattagatcagttactcagtcaagttaaagtatccctctgataactgatttttaaaatgctatcaatatccactccctgtcagtctgccattgttaatggtatacagcattatggaatacaatggaattgatgaagccgatatccacggacaaaccgtgacttatgatggtttgatttatgattttcaactttatgatgggtttattgggatattagatgcgtttttgagttacactgggtttatgagtatgtgaccgtatactccagaaatagctgtataaagaaaaagaagtgtacctaattaaaatatactgagtgacttgggagaaaccaatagatgtttacaactgatggagaaccaagaaagagagatagcggtaaataataacaataacacaattttcctgcaactgtcgaggatttccccaaaattcacagaatgtaggatgcacctaaggcatatgaatgggagaaggcagaaggagtaagagagaaataggaagcaaggaaggaaggaaggaaggacggaaggaaggagaaaacacccggtggatactaaaaccaaaaaaaaaaaaaaatggtttcccactgtgggtaagactataatgtggatgaatcttgaaaatattgtgctaagtgtaaagtcagtcataaagtctcacatactgtgcaattctgtttataggaaatgtccacaatatggaaatctatggatatggggttgatcgctctatgtagttgttacctagggctgagggtcagggagagggtttgagacagaatgaggagtgaataatgtttacagggtttttctctggtcgggggtgataaaatgttctaaaatggattgcgaattaaaactgaatatgcacaaccacaaatatactaaaatccactgaattcatgacttttaatgggggaaacttacgtggcacactctcatcgagaccacggcagacatagtgaatgagaaaaaggtgagtaaatatctgaaagggaggcagaaacagaaagaatgaaaagccctgtgaatggaagagagagagaaaagggaaaatggtcctatttacaaatgacagatctgaaactggggctcacatcaacagtgtcactgccagggaggaggggcatgctagccatgtcaccggtagtgtcacccgcagggacgctgacatgctggaggttcgtgtcagcatgggctctggcagccatgtgggccagcaggagggtcccgctgcacagctgtggggtgaggatagcctgggtggtgatatcagccattacaggggcctcttctgctggcaacagtgtgacagtagcaagtagatggacaggcctgtgtgtgaggatggaatgcaggaggggctcttctgcggctgggtgtggggccctcaccagaaatgtggagaaatggccaggtaactgtgtcatgttggctagtagattggccagggcttcgaactgaaggacaataacggggagtagctgtcaggccctgggagtgtctgagtgtaagtggagatgggtttggggtcactgagggatacgtgggagccatccctgtatagatacaggtcatagggagatagtctcatgaggcctgtgagtgtctagggttctcctgggtgcctggggctgactgcggcagaaatctggggaaggctggagagaagctgggagacacaggagagtccctgaaggctgggggtgaagaggtgaaagaaatgggggaggggtgcagtaaggtccgtgagtttgtaggtgattcctgggtgtgggaagctgaccccaggtgaaatctggagatggttggagagtaggtgagagagacagaagagtccctgagggctgggggtgacaacatgagcgagactggggagtaagtcagtgaaattggtgagtttggtggtgtgccctgggtgcctggaactgactccagctggaatctagagaagttttgagagtagctgaaagagacacaagagtccctgtgggctgagggcaaagaactgagagagaccagggaggatctcagtgaggtctgtgagtctgtaggtgattccggagtgtaggaggctgactccggctgaaatctgggcgtggcgggagagtagctgggacagacaggagagtcccagggggctgggggtgaagacgtgagagagactggggagtaactcagtgaaactggtgagtttgatggtgactccggggtgcctggaactgactcccgctgaaatctgggcatggttggagagtagctgggacagacaggagagtccctgagggatggtgaagacatgacagagactggagagtaattgagtggaattggtgagtttggtggtgatttctgggtgcctggaactgacaccagctgaaatctgggcgtggttggagagtagctgggacagacaggagagtccatgagggctggtgaagacatgagagagactggggagtaacgcagtgaaattggtgagttcggtggtgatttctgggtgcctgcaactgactcccgctgaaacgcgggcgtggttggagagtagctgggacagacaggagagtccctgagggttggggataaaggcgtgctagagactgaggagtaattcagtgaaagtggtgagcttggtggtgatcccttggttcctggaactgactcccgctgaaatgtgggcatgtttggagagtagctgggacagacaggagggtccgtaagggctgggggtgaggacgtgagagagactggccaggatctcactgaggtctgtgagtttgtaggtgtttctggggtgtgggagaccgactcccgctgaaatctgggcgtagttggagagtagctgggacagacaggagagtcattgatggctgggggtgagctgctggatgatggcagtaagaacacatgatatattattgatgaatgaggtgactgtgaagaatctccagaggaggacaagggagagcataatgacatgagtgattgtcctgcttggttaggaaagggaaatgtaaagttgtgaaattctgttgatgagggatgtgagagtggtgaagtcctgcgggatgatgtagagtacttccacatccctggtgaggagctgccccttgggtctgaatttctgggaggggagagggagaagctgggtgaggcaggcatgaatcttgaggagtcagggctgagggaccgctcataatctcccgagacctgtgagtctctgggagactcataggtacatggggctgactcccgcagaaacctggggatggttggagagtaactgggagacacaggagagtccatgacggctgggggtgaagagaggaaagacataggcgaggagcaccgtgaggctcgtgagtttgtaggtgattcctgggtgttgggggctgactccagatgaaatctggagttttttggagagtagctgggagacacgggagactccccgagagctgggggtgagctgctgggtgatggcagtaagaacatgtggtatattattgatgaacgtggtgactctaaagaatccccagaggaggacacgggagagcccaatggcttcattggttgcccatcacggtgaggaaagggaaatgggagcttgtgggattctgctgatgacagaggtgagtgtggtgaagccctagaggatggtgaatggtagctccaggtccctggtgaggagcttcctcttaagtctgagtttctgggaggggagaaggagaagctgggtgaagctagcatggattttggggagtccgggctaggggaccgttcataagaagagccagacaagaccccactgttcttagacgcagacatgattaggaaacctgcagctcccagggacccctaccaattttctaacccccagaatgaaggagtttgtgtgtgtgtttatgtgtgtgtgtgtttttgtctgttgtgacatatgtgctccttaagaaaatggaaatgaacaaaccaatgtgacagacagagatttacttacccaagtgtactgtcctatcctctgaatctacttccaagtcgtaagacgctgtaagctccaggtccacgctgagccggcagaacgctccagccgctgctctgctctgcgaagatctgagctcgaggccccccaacagggcgggtttaaatagccttgggcgcagcctggcagcggaaagggcggagcttcactcctcctttccatgagtcacccccaactttcccaggctacacctcgtaggaaactgttcccctgatttgatgtcttgtgacatatttgggacaatctgagaacttacaagctttgttgctcaactacattatgaattaaatgcacttaaacactgaaaaccatgtagtggttctgtggttctcacattgtggttttgacaccagcagcatccttgcaacacacagaccccggagatccacagatctgtgtggtaacaagccctcccactgaccctgatgcatggcagcttaagaattacccgtataagtgaaaagacttttaagaaaaagtggtgatatacgttgtgtaaatattcttctgctctggaacaatgtagagactccggggccagttgggtggaacatttattggatgagggtgcttgggttagtaatatcaaggtgtggctccagataattcaatcatctaattaagtttgcagttatgctaatctgttttaaaattcagtttgtgtaaattcttttactcagactgagaatggcaatgcctcaaccccaatttccagggagggttgagagcctcaggttgagttgatcaccaatagcctatggttttacccatgatgcctatagaatgagatctccataaaaactgaaaaggactgggtttagagagcttctagataaaacttcctggaaggtagtgtgcccctccccccatgcagggccccatcaatcttttttctgaattttttgcaatatccgctataataaaatggtaaatgtaagtgtttccctgcgtgctgtgagctgttcgagcaaattaatgcaactaaatcaggggtggtgaaaacctgatttatagccagttggtcagaagcacaggtaaaacaacctagggcttgccattggtattagagtgggaggccagtcttgtggaagtcagccctgtgtaatctaacgctatgtccatgtagatagcctcataattgaattagaagacacccaactgatttccagagcagaatgcattgtgtgcttgactgaccgagagaaatccccagacatgctgtcacagaaatcttctgtgttaattgttgtgatatgagagcggaggaaaaacagtttttgtttttttcactcagcctaaaatgtaaacgggtctattttctcacactattgaggatcacttgatttacaataaaaatgtttagtctttgatatataaaaaggatgttggttttcattttattgctaacaatcaaggtggtcatagttgatgtctttttgtcatttttcttttcactgccttgtcatgtctttcacccactttttaattatttaatttttaactgaaaaaaatttttaggccgggcgcactggctcacacctgcaatctcagcactttgggaggccgagacgggcggatcacgaggtcaagatatcgagatcatcctggccaacgtggcgaaaccccgtctctactaaaaatacaaaaattagccgcgtggtggctggcgcctgtagtcccagctactcaagaggctgaggcagaagaaccgcttgaacccgggaggcagaggttggagggagccgagatggccccattgcactccagcctggcgacagagctagactccgtctcaaaaaaaaaaaaaaaaaaaaaactagagacaaggtcttgctgtgtcacccacgctgaactgtagtggcccaatcacagctcactatagcctccaatccctgggctcaaacaattccgctgcaacagcctcttgagtagctgggaccacaggcacacaccaccaggcctagctgttcacccatttttcaagtgttcattttccccccttcattgttttgtgaccatttcctcttaaggaaattagctactaaccgtcatatgtgttgagaataatttttctagtcatttgctgtatgtcttaattgcaatatgtgatcaaattctttgtctttactttataacacctgggttgagaaccattatttgaaccaaaaattggtctgtcactttttcagtttgagactttattttgccgctagcgttttgtttttgttttgttttgtttttaagttctggggtatatgggcaggatgtgcagatttgttacataggtaaacgtgtgccatggtggtttgctgcacctgtcaactcatcacctaggtattaagcccagcatgcattagctatttttcttaatgctctccctcccctaaccccaccccatgacaggccccaatgtgtgttgttcctcttcctgtgtccatgtgttctcatttttcagcttccactataagggagaacgtggtgtttggttttctcttcctggattagtttgctgaggataatgacttcacatcgctagtgttttcttaaatgtcagcatatttctgggacttcatttctctttttgctaatgcaaattacatgcatgtttaagataatatttgcttatgttttaatttttttaagttaaaatgaaagtccccattgctatatcaacctcctctctcttgttactttcatttccctcccaaaattaccgttattaaaaatttcaccttagttgtttcagatcggtttctatatatttacacagatatttgtgtatagttaggaatagagtttggggtttgtgtgtttgtttttgcttaagtggtggacgcctgtcatcccagttactcaggagactgaggcaggagaattgcctcaacctgggaggtggaagttgcagtgaaccgacatcacatgccactgcactccagcctgggtgacagagcaagactccatctcaaaacaaaaacaaacaaacaaaaaaagctggctcttattaatccttttagtctttttccatcaggagaacaattatggcattacattatgttaatttttccaggtaggagatattggccatcctcttattttttgagacaagatctcatcctgtctcccaggctttactgcaatggtgcaattagagcctcaggagatcctcagtctcttgagcaactagaactacaggtgtgaaccactgcacctgataattttcttttaaattttttgtagagtcgaggtctcactatgttgcccaggcttgtctcaaactcctgggctcaagctatcctcctgccttggccttccaaagtgctgggattacaggtgtgagccatctctccctgcctcttcatcctcttataagcttattcttttgtattccccttgctatttactccttgtttctttctgtttaggtatgcatcttatttatgaactctttgtgtgtttttttctaggttttgatcttttttcttctgttatatgtattaacaagaaatttactttcaacctgttgattgacatttgttttcatggtgatatgttttagaaagtaatatttcttaataagaggaattatattgctaaatgtagtaatgatgaatttccatgcattactgttgtactgtaataattttaatatgttgatggattttgtttgctgctttccataaaattttgcagttctattcattgagacattttcctttagttttctggctgttttttttttgttgttgttgttgtcgttgttgtttttgttgttgctctgttagggtataatttggttatcaagattatactaggatttggggtagtaatataataagttaagaagctcctaacacgttctgctctctggaaaagtttattctaataatcacctcattgtaggtttgtattatttctctcttagagcattcagaatagatttcctatttggggatgaaccttaggtttcttctgaggttgttgttttatttagcatttatactgcttgttaaatatatttgcgttctctatatattccctgagaattatattcttcatttcacctctgtttcttctgtattacctgctttccactttctctggttttgttttgctgctgtatatctgagacatagatagttcagtgttaagagcatggggccaggctcagtggctcatgcctctaatcccagcactttgggaggccgaggtgggtggatcacgtcaggtcagtagttcaagaccagcctgacgaccttggtgaaaccccatgactactaaaaacaaaaaatcagcggggcgtggtggctcatgcctataatcgcagctaattgggaggctgaggaaggagaatcgcttgaacccaggaggcaaaggttgcagtgagctgagatagtgccattgcactccagcctgggcaacaagatcaaaactctgtccaaataaaaaaagcttgagctctggaaacttcctctcagtttgttgtactagattgtttagtagttggtctgccttttactagacatgctgttctctgtacctcagtgtcctcatccataacatagcaatataatagtgcccattttgtagtgtgacatgagaattaaatgaagtaatacacatgaaagacttagaacacacaaaccctaaatgcatatcagctaccactgttattaccactttcttgaaatggaagttaagttaatttattttcactcttgtgtttcataaatttaacgaatgttacaagttttcctctgagtatgattttaagctattttcctctgttttggatatgtacttcttttgtttttatttattttcaaatggtatgtgactattattttgatttcctctttaatccaagcctgcatttaaagagtgtcctcgggttcctttcaatcttgaggtgaataaataacttacagaacactctttatgtccttttgtgaatttaattgcattatggtcaatgaatgtgacctacatggtttctgttctgggacatatgttatctgttgcattcaaaaactaccatttgagccaggcgagttggctcaggcctttaatcccagcactttgggaagcttaggcagtgaagttcgagaccggtctgggaaacatggcaaaaccctgtctgtacaaaagattaaaaaattagctgcatatggtggcatgcacctgtaatcccagccacttaggaggctgagacaggagattccttgtctcaaaaacaaacaaaaaaacaaaacaaaacaaaacctactatgtgtttaactcatgattctataaatcagtagtttgagtgtgcctcagccaggctcacgcttgcatctgagtcaacttctaagttcacactgcatataatagaactcacgcatccttgtcaactgcaccagctgggtcctggggtggggtggggccctcaactgggatctctgccccacttggtcttatacttcagcaggtcacacactcacgaagtcatagcagtcacaatggccccagagactgaacagagttgtgcattctgtcagataaaataagtcacaatgccagcattccagggatgggggaatagacttcagctcttgaagaaataaggggctacaatgtcacattgtcaagagtgaaggatttggtcacttctgccatctcccacagaaaataattcttgagctgtcatatgtagtctatattttgttcttcatcttagtttctcagtgctttttaatgcatgtttcaaaactatattagtttcctcaggctgctgtaacaaagtaccagaaactgggtagcttcaaacaacagagattaattctctcacacttctggagaatagaaatctgaaatcaaggtgtcagcagggccatgctctccctaaaagctctagagaagaattcttccttgtctcttcctagactcagtttccagcaatctttggcatcccctggcttgtatcattccactttttgcctccatcttaacatggcattttccctctgggtgtgtctgtgtccaaagtttcttctgttttttaggacagaaatcattgcattaaggcccaccctaatctaatgtggtctcattttaacttggttatatctgcaaagatcctgttggtcaataaagttatgttcataggtactgggtgttaggacttgaacatatttttgggatgggggggcacacgattcaacccacaacaaaagccatgcatttttttctggtctttgtgatataaaaattatgtatacatgaatatttacagcattttgtacttcaaaacctttgtatcttttcattttatgtcaatgtctctgtcacttttggaaagcaaatgatgttcttcatcctatctcattcatcctcctccatgactattcactagtccttatttaaaaaaaatcaaaacctcagtttccatgatcaatctgcaaccccatccctgaagtttatgcatccttccctctagtatcccaactccagcaataccttgtcctgagggaaacttcaattcataaacccatgaatttctatgactttatcacacatctcatgttcccatttttttctccatacccaatccatagtgcattatgaccacaaccttttatatatcctgagttcccattccattatctctcttgcttttgtggcaaaactcttacccttattaaatgcaaatttttatcacaaacttgttgggcatgttggctcatgcctgtaatcccagcacttcgggaggctgaggtgggtggatctcctgagatcaggagttcgagaacagcctggccaacatggtgaaatcccatctctactaaaaatacaaaattagcagggcatggtggtgggaacctgtaaccccagctcctcaggaggctgagacaggagaatcgcttgaacccaggaggcagagcttgcagtgagccgagatcgcatcattgcactccagcatgggcaagaagagcaaaactctgtctcaaaaaatcaaaataaacaacaacagcaagaaaatgtatcacaaacttacctgagcagtggctggagaaaaaaacacacaattgtgctaccaggtcttcctctaaatttcaggccacagacaatgagccagtgctcactgcttccaggcaatcctactctatttctctagactattcagcctcccatttgccagaatgaccatttcccacttttccatctcttcccaaacatcactccctgccctcttcctccttcttcccttctagctcatgaccttgcttctcctttcactgagaaaataaaatcaatcaggaaaaatatgccaccttctactatgatatctagcaaatttcttgcactgaatccccatatgccttcatgtcaccatggctgggctgtgcctgcttctaactgtaatcccctcagcttgtgcccaagatcccatctcttcttgactagtcaagtactctgttcctgctgctgccccttcaattctccagcaccaccagcatcactctctttcagtgcatttccatcaacttaggaacttggttaacatctccagtcttggtaggcatgggatggtatttgattccattagccttcctagctaccctccctcctttcactgctgttcttgaccacaagttgtcaagagacactgcctcagtttctccaattcttttaaaactcactccattcatgcttcccacaacctccacatcatcctgtctggcacacacatttccccatagctgctctagttaagattacatcgccaaatccagcagtcagttttcagcctctctcatcttacttgacctaccaatagcatatgacaccacttgtatcattagtgtggatgattgtttccattagtataatgcagcattgtctcaattagtataattatattaatatgcattaatataaattctattaatattattcactataaagccatgtgggaggttatgattctactaccactcatacagtttttgttttcctggtgtttctaagtgcttttttggtacattatatgtagttattatttctccaagttttcagtgtctcaaatatgttctataatgtatggagtctactttttccagattccaccttcctggatccccccatctttatccttccttgagggctgattaccatcttggcctgattacagtctggttcagtctcctgggacttcctttcgctgtgatccagcaaaaaatccagggttgaatttcctactccctagatgctaatcttcctctttcttaaattattacctcatttgctgcagcacgtaatcaagtaacagcatgagggttacttctcctgcacttaagagtacataaagagtacataggaagtacattttctgaatcccagtatttttccatttaggcaatttatagtttgcataactattactgggtctaagttgacaatcattttatttcagaattttaaacaaaaatatgaattgatgggcagaataatggatgcaattgctgaaggtgcaaattagtgagctggaagattaggcaagggattattccagagagtaatgcaagcagatggcacattaggatatgtgatgggtatatgatggatattaggagacatgaaagaaggaaccaacatatggataataagagtatcacaaagggagggaatatacaataatggggaggaaaacctcaaaagaaaaaaataaaataaaatatcccagagctggaggagagatttgagattctaattgaaaggtcctgctgagtgcttaacaggaagaagcaaaaatctcgtcaaattaaattatggtaaactttcagctgataaagaaaaaaatcctaaatgcctcaagaaaaaaagtaaaacccaaatattacctattagagattgaagaattaatttggtatcatagtattcttcagtaataaaaactaaaagagagagagataatgtttcaaagttatgaagaactgtaacttgtgtctaagtattatatgcccaggcaagccaacatttgctgtgagagaagaatgaagacataagacaaaaggacacaaggaacttaccaacttcagactgtctgaaaaaacttcttaagaatacagtccagcaaaataaataaattcaagatagaggaagatgtacagtatgtacaacaagcaagaatatacagtaaatcttaaggttaaatctaaataattgtttatatgtgaggaaaaaagaaaatttagtgttcagattctagaagacataaatatgggagatgagaggagaagaaaggaagaaagcttgttaaaaacattcttgtgggccgggcctggtggctcacgcctgtaatcgcaggactttgggaggtcaaggcgggcagatcacaaggtcaggagatcgaaaccatcctggctaacacggtgaaaccccgtctctactaaaaatacaaaaaaattagccgggcgtggtggcgggcacctgtagtcccagctactcgggaggctgagacaggagaatggtgtgatcctgggagtcagagcttgcagtgagccaagattgtgccattgcactccagcctgggcaaaaaagtaagagactccgtctcaaaaaaaaaaaaaaaaaaaaaaggaaagaaaaaaataagaaaaaaacatttctgaccagacatgatggcttgtgcctgtaatctcaacattttttcagtccaaggtgggaggattgtttgaacacagatgtatcagaccagcctaggcaacacagtgagactctataagaaaatttctaaaaatcaattaggcatggtggtgcatacctgtagttccagttacttgggacactgaagtgggaggattactcatgcccaggaagctgaggctacagtaagcaacagagcaagaccatgcatcaaaacaaacaaacgaaaaccaaaacaacgaacagaaaacatttttttaatttggaaagatgatatcaacactgatgaactctaataaacttttaatagaggaattttataacttatatttataaaacatcttattatgttgctataaacatgtgtatgcaactatctttttcatataatgacttcttttcctctgggtaggtacccagtagtgggattgttgaatcaaatggtagttctacttttagttctttaaggaattaccacactgttttccatagtggttgcagtagtttacattcccagcagcagtgtaaaagtgttcccttttcagcccatccccaccaacatctattattttttaaattttttattatggccattcttgcagctgaaaggtggtattgcattgtgtttctgatttgcatttccctgatcattcgtgatgttgagcattttttcatatgtttgttggctatttgtatatcttctttgtagaattgtctattcatgtccttagcccattttttgatgggattcttcgtatttttcttgctaatttgtttgagttccttctagattctggatattcatcctttttcagatgtatggattgtgaagattttctccccctttgtgggttgtctgtttaatctgctcagtgtttcttttgctgtgcagaaactttttacttaaattaagtctcacctatttatcattttttctattgaatttgcttttaggatcttggtcatcaagtctttgcctaagctaatgttttgaagggtttttctgaattatcatctagaatttttatggtttcaagttttaagtttttgatccatcttgagttgatttttgtataaggtgagagatgaggatccattcacattcttctacatgtggcttgccaattacaccagcaccatttgtttgaatagggtgtcttttttttttttttctttttgagacggagtcttgctctgtcacccaggctggagtgcagtggcgggatctcggctcactgcaggctccacctccttggttcaatccattctcctgcctcagcctcccgagtagctgagactacaggcccccgccaccgcaccagtctaattttttgtatttttagtagagacggggtttcaccatgttagccaggatggtctccatctcctgaccttgtgatccacctgcctcagcctcccaacgtgctgagattacaggcgtgagctactgcacccgacttgaatagggggtcttttccttactttatgtttttgtttgttttgtcaaatatcagttggctgtaggtatttggatttatttcttggttctgtattctgttccattggtctttgtgcctatttttataccagtaccatgctgttcaggtgactacagccttatggtatagtttgaagtcaggtaatgtgatgcctccagatttgttctttttgcttagccttgctttggttctgcgggctcttctttggttccatatgaattttagaattgtcttttctagttctgggaaaaatgatggtggtattttgatggaacttgcattgaatttgtaaacaacttttggcagtatggtcatttttacaatattgatttacccattcatgaacatgggatgtgtttccatttgtttgtgtcatctatgatttctttcaacagtgttttatagttttccttgtagaggtctttcacctccttggttagaaatattcttaagtatttttttttttttttgcagttcttaatttcattcttagcttggttgctgttggtgtacagcagagttatgatttgtgtacattaattttgtatcctgaaactttgctgaattcatttatgagttctagaagctttttgaaggagtctttagggttttctatgtatatgatcatatcatcagcaaacagcagcagtttcactttctctttactgattcgatcgtttctttccctccttttgtttgattgaggttgttgttgttcattttctttcctttagagcagtgattttcaaggtgttactgttgggtgttttgaatggatgacttctttgttgagataattaatttacagatgcaatatgtttagcattccttacctctgcatactaaactcataccccagtcactggagcaagcaaagatcacccacacaattcaaaagagtcttaggggggctatttccttcctctttgagggtccctgttctactttttcattttctttttctttttttagacataaaatctcatgctgtcacccaagctggagtacagtggcaccatcattgtccactgcaccctgaaccttccaggctcaagccatcctcccaccacagctgcttgatcaactaggattacaggccagagtcactgttctatagttgggaattagaagcagctcctagatcaattattccagcactttgtcttttgttcctaacacacccatttaagtgtgtattttcagactaaagacaagctcttagattaggtaaaagtaacatttaaaaataactataataataaagagtatataaataataagataaaaaatgctaattttacgagaaagtgaaaaaataaatactagaggaaatctaatgaaaagaaagcaggtacagtcggcactgaaaagtaaactcaaggtgaaaatacaaagtacttaaaatgttaatgacatttttggtccatcaagaagatatgaccattatgaaacttacacagggtcagcatcactaaattttaaaatccaaaatgttccacaatccgaaacttttggaatgtgaacatgacaccacaaaagaaaatttccacacctgaaatatttgctttctttctcttcttttcattaattgatttttctttggtcatctgacgaaggcaatctttgcttctgatggttcaatgcacacaaacattgtatacaaaccttgtgaacaaaattaatcaaataattctataaaattaatttcagggtacatgtataaggtgtataggaaacgcaaatgaattttgcgtttagacttgggtctcatcctcaagatatctcattatgcatatgcaaatattgcaaaatctgaaaaaaataaaaaatctgaaacacttctggtcccaagtgtttcagataaggaacagaccacttccatacctaataacacaacttttaaaatgtaaagccgcttgtatacctaataacacgacttttgaaaaatgaagtaggctgggcgcggtggctcatgcctgtaatcccagcactttgggaggccgaggcgggcagatcacaaggtcaggagatggagaccatcctgactaacacggtgaaaccctgtctctactaaaaatacaaaaaaatcagctgggcgtggtggcgggcgcctgtagtcccagctactcgggaggctgaggaaggagaatggcatgaacctgagagggggagcttgcagtgagttgagatggcgccactgccctccagcctgggcaacagagcgagactcagtctcaaaaataaataaataaataaataaataaataaataaataaataaataaagcaaatgctatagagaggaaaatgacaaatataccattatagacttttttttaatttttctttctttctttctttctttttttttttttttttttttgagacagagtctcgctctgtcacccaggctggagtgcagtggcacgatctcgctcactgcaacctccgcctcccgggttcgagcgattctcttgcctcagcctcccaagtagctgggactacatgtgtttgccgccatgcctggctaatttttgtacttttagtagagacggggtttcaccatcctggccagtctagtcttgaactccttaccgcgtgatctgcccacttcggcctcccaaagtactgggattacaggcttgagccaccacgcccagcctgcgagcctttttgacatgaacttttcaatcattgacagatgcataatgaaaaaatctaagtaagcataaataagcatgtaggaaatttaaatagcacaattaacaagtctggtgaaaatataaatgtatgcatatccctctgatagagaaaacgcattgttttccaatagacacagatgtcacaaaaattaacattgtattagatcaaaaataaaaatgttcctgaactcgctttttaaaattcaagtatgtcaaattaaatcaagtaatccttcaacttagagcaatatataagaacatcaaacatgtaaacatcaaaagacagaaataagccaaaagaattgcactgtccctttatgtgccctaagttgcaatgtcaagctatagttggatattattcaaccatttcctgcccattgcctagaggtaggggtcttcacttctctgtctaatctaggactggaactgcctcacgacccctacagcttgagggtgcatggaaaacggaatgccagccagatattccaaacagagcctctaccagcaggaccaggtgaccattcctaggagagagattgttctcacccattatcagggctttcctccaggctaaaactgtgggtctctaatggaattcttattcaattttcccaccccattagagtacacaaaattgtctttaatagaaatcttaattttttttaattttattattattatactttaagttgtagggtacatgtgcacaacgtgcaggttcgttacatatgtatacatgtaccatgttggtgtgctgcacgcatttagcattaggtatatctcctaatgctatccctcccccctccccccaccccacaacaggccctggtgtgtgatgttctccctcatgtgtccatgtgttctcattgttcaattcccacctatgagtgagaacatgcggtgtttggttttttgtccttgctatagtttgctgagaatgatggtttccagtttcatctctgtccctacaaaggacatgaactcatcatttttatggctgcatagtattccatggtgtatatgtgccacattttcttaatccagtctatcgttgttggacatttgggttggttccaagtctttgctattgtgaatagagccacaataaacatacatgtgcatgtgtctttatagcagcatgatttaaaatcctttgggtatatacccagtaatgggattgctgggttaaatggtatttctagttctagatccctgaggaatcgccacactgacttccaaaatggttgaactagtttacagtcccaccaacagtgtaaaagtgttcctatttctccacatcctctccagcacctgttgtttcctgactttttaatgatcttaaatcttaaatgcaataacataaagtaaaataaagcctaagtcccaacaaggggaaattttcaaaaataatctgaaaacttcccgcgttttcttgttatgttgtaatgagtactcctgcaattcccctattaaggattcagtcaatggttgttaattcattctgcttcttctgagactaggaaaaaaattacagggctatgttatatcgcaagtgtagattatgcagtgtcttcatcaacagaaacaaaacatggtgtggggcggggatggaactatttaagtgaattttaattgaaaagtttcgtggttttaacattaaaagacatgcctataaaataagaacctgtaaaagtcttcactaaaatggtaaagtgctcatttccaagtagtaaaatattgaaactttttcttttcatcgttgatagtgatttaacatttcattactttatcgttattatgattgtcattattttagacgaatgcacgaagtcaaaggacttccaaatgcacggacgtcaaaggctaccttcacccgggtagccttgcgaatggccactgctgcgagtggggctttctggggattgtagtccataggcctccttgcgcaagcgcgtggtaccagacgcaagctaggggcgacattgtttggaatgctgggttgagtcccggctggaccgcgcccctctcggaagtgtagccaggagtaggggtgtaggatgtgcagctgtgacccgtccctgtggactgaagtaggaggagtggaggaggggactggtgaccaatgaaaaggcctcgtgggtggggtaggctggggaagttcagcagcccctatctacccgggatggaatgggaagcgcttgggctcagtttggggagcagccctgggtttgacaaaacgtgcatcttcacgtttcgtgacagcgacttgcgctgtgccaccttgggtcgaggcttagggtcagtcttggaatgtgcatccctggatgagggcagaggggcgctggctcagggtttgggagtaatggctggggctgtgcctccctgaatgggatgagggatttgcttaagcagcttgtctctggagatagaggatggcttgggctattctcgctcagtttggtgggggcgattctggctcagcacccctaggttcttggatggggagttgtcttgggtctgaactctggattttggcagctctgactccactggggcatttctgacttcagggcagaggttccggcttctggcaataaagaaacaactcagactgtaaaaactctggagtttaatgtcaccgaacacattttgaaaagaactgccccaggactggcgcggtgtctcactcctgtaatcccagcactttgggtggatcacgaggtcaggagatcgagaccatcctggctaacacggtgaaaccccgtctctactaaaaaaaaaaaaaaattacaaaaaattagccgggcatggtggcaggcacctgtagttccacccgggcatggtggcaggcacctattgtcaggagatcgagaccatcctggataacacggtgaaaccccgtttctaattaaaaaaaaaataataataataacaaaatattagccgggcatggtggcaggcacctgtagtcccagctactcgggaggctgaggcaggagaatggtgtgaacccgggaggcagagcttgcagtgagccgagatcgcgccactgcactccagcctgggcgacagagcgagactctgtctcaaaaaaaaaaaaaaaaaaagaaagaaagaaagaaaataaaagaactgccccaaattattaactccattctcacctcacatgctgtgagccagggagtacggaatttgagtattataaagcacacgagcaaatgtaagttgttaaattacactcaccaaatttgaagtttgaatgctctctgtatatttgataaagttagagatttagtgttaattattttaggtgtaatagcagcatttattacatttctgatcgtgtttctggacaattgcagttccagattcagctgcacttttcctctaggtcttcattccctgaagaggttgatatgggcatctggtctcattcctgatgtattcctcagatcagagtagttgtcagtttgagggatgagaaaggcatttgtgtgagagagctgtgtggactttggcagatagggaaaaaacaagagtcctgaggtgctatgtgtcccatgcctttggctccccaccttttccaccctgctgtctgccctgaaaggccaccattgccttctggccttgcttgtctttggccagtgggaagtctcaacaggaaagtttggagagaggaagaagtgtgagttggaggatcttgtcccccagttctctctctgcaggattgtcacagattagctgcccttctaaacaacaggtcatggtttgggtggccctggccacacagtcctctcagttccaggctccagggactgctccctccccttacctcttaaggcccaggtattataatggcacctcctgtcacttcccaggatagagccttatccactctgatttccttacccccagccaacaccatcgtaagccgtctgtttattaaactcccctcaaatttgaatgtgccatctggttcctgccatggcccatagttgatacaggcagggagtgtctgaagccagaaattcaggaaaccaaaccctcaaccatatatgtgtgactgcatgtgtgtagatgtgtgcttgaaaataaacctgtcccatcattggctcttaagtgagaacaggtactagaagtagagggcgagtttatgtctttgcgcgtgcgtataatgtataatatccaagccaattctatttgttcatttgttaatattaagaaacattgattgagtgcttgttaaatgataagatccttagcaagtacagtggataaaagactacagcttgttttttttttttttgttttgtttttaggatttgtagttttttgacaggggaaaggaggagtgtttccttggtaggttttaactattgtaaaatgatgtaattcatgctgtattaataagttgaacattccttattttggcctttgttggagcccaaaataagaagtgattaatgatgtctcttaaaggtattaaaggagagaaaaagagtccgaggatttaccaaaaagacatttcatattctattaacctgattctataaccctgtaagctgcaattcaaagggtaaccaacagaccagtgccaataaatgatattggtctgtgaccagataatttgagaacttgattgtagatgtttaaaattttgtcttattgattaatataataataacaattgggctttaatttgcataccttctttatttcctttttccagtaatttctttttactgtatcttaccaaaatatcagtctgtgacagactgaaagtaacggtaataataatataaaaactagtcctttatcacagatagtgtgagaagcactatctgagaaggcagaaacgtggtttttggcttttattttttaatctttggagtttacacagtgcttaaagtggcaattttatacagtaagtttccccacaaaggcgagaggcaattgtgcttacagggtttaccagatggaatcccaataaaaaataaacagaacactcaaattgggtaatttgagaagagcttaataaagggacaatctataaagttgtaggcaggctgtggtaatcaacaaagggtattgcaatatttcagagctagtgatagcagggtaacttactgcctttaggactgaagggctaagggaggaggcagtcactaaaatgtgaagaaagatttatgggatgacagctgcctgatggtggccatgacctttggtcaatgaatatggagcatagccattccacagcaacctctagggaaaaacctgggggaataaatattctgacttcactcttgtcccttccctggatctcttgctggctttccccattggctgaacccaactggaagctaattggcaagggcatccactgatataagcagaacaggaagggactttagtgtatatgaagtggcaagcttagaaggtctatctatctactttggtctacgtgcagtctgagaacatgtatagttcagtatactgtgagcatttccagagcagaggatgtgtcttacatgtcataagtgtgtcatcaatatttgcaaaagcaagggataaaatgggtgctggagagacagtttaggaagccaagagtcaaggtgtagatgtttaaaaatttgtattattgattaacataataataaaaattgggatttaatttgtatatcttggctaatcgcaagttctttagaccacaggcctggccatacaagatcaagtcttgcatgtgaaagtggaaatagcagaaggtccctgtcatcctgagattgctctctcttttttttcctttttttttttttttgagacagtctgtctctgttgcccaggctggagtgcagtggtgcaagcacagctcactgcagcctctgcctcccaggttcaagtgattgtcctgcctcagcctcctgagtagctgggattacaggtgcccgccaccaagcccagctaattttgtatttttagtagagacagggtttcaccatgttggccaggctggtctcgaactcctggcctcaagtgatccacctgtctcgggttcccaaagtgctggggattacaggcgtgagccactgtgcccagccctgagattgctcccttactcagcaattctggggcctcttttccagcataattcagatgtagattatgtcagttcattcacaagtctgagaaaaggaaaagaatgtgcaggttttgacccaaaagcttgaggagagagataggagttacatagtggtctgagattgagggactggggacaaatctagggaagtcttgaggaggtgggagttcagtctgttcagaatgagaagagatgatatctagggagagaagaaattgtgagaaatttgtacagataaggaaggaaccaatgttcatttataacttgttgaatccatgatctcatggattctttcttctttgcagttctgcttttccagaatcctgccctttccaaaaggaagacggtatgattaagttccaggtaagttaagggtttctttctctttaaatatactgttcattctgaggaaccagcacttctgttttctgaaaggtcagcattttttgagtgactactatgtattaggtacttcatcttgctcataatgactttgtgaggcaggtggtttgacttcctttatagaagtgaagaaacaaactcacagatttcaagatgtctactttggtgctactctaagtgtggttcatgtaccagtaccagtccatgaactgcttatcactgccccatgagggaaaaagaatcaagactaagttcagaagcttttatagcaatttggtgttgccgcagcatctgagtgcatgggcagcatatacatgaccatactctaaatgtcactggtctcgtttgataagtaacaagatttgaatgggtatgtatttggtcagagttcaaccagcaaggtagaaccagtaagagatatatattaagagatttatcataaggaattgatttatatgattatgggggctaactaggcaagtccaaaatccacagggcagtccctcaggaagggtgggccagaactcttagacacagactgaagctgctgtctatgggtggaatttctccccctcccagggaagcctcagctctgctcataagaccgttcagttttttgagtcagacatactcagattagttagaataatctcccttaaagtcaactgattatggactttaatcacatctacaaattatcttcatagcaatacctagattagtgtttgattcaataactgaggaccatagcttagccaagttgccatattaaaaagaccgtcacagtgtggaggaaggattttcttttaatcatgaaaaaaattaattatgaaaatacacaaaaagaacaaatggtattatgaggctccatttgcagtacccatcatgcagtttcaacaattaacttattgccgaagggatttgcttactctctttttcagttttttctttcccagagtatttgaaagaggcatggtatttacactgtattggtttttctctgagcacatcacttttgtatagtaccttattatatatgcagctaaaatgaatgagctcacacttttatccttctgcctggaaaccatcttgcccaagtccaagattcattaggtacattttctatcttccaaattacagcaacaatttaccaagtgttcaccactacatcacccaggtcaccatttttccagcctcctataacagtgtcctcaattgttatggcctggacctaaagccaataccatgagtatttggtagcactctgctggttttggttagcttgggtgtgtcctcatagtgaagacagagggacaagagagcaagtgaacacgtgagatctgtcaaggcccaggttagaaatggcacattctcacttctgcttcattttggtagccagagaaagttacattgccaagtcaaaactaaaggggtaagaaaacacactctggtcctttagtgggattggtgagcatggaagaggatatttctaaacagcaatctaatttactacattctctatgtatttcagtatatatttccttaaaaactgactaatgagataatcaataattatttggtattatctaatacccagacaataaccaagtttccctgattatctcaaaaaatttttgacagttggtttgttcaaatgggatcttaccaaaggtctatactatcatatagttggtggttgtgtctcataatctcttttaatctagagaaatctgcccctctactttattctctcctgctattgacttgtagaaaccaagtttggtgtcctgtgttctttcctacatttggaatgcatttgtttgcttccttttggtgtctttcaatgtgttactctatccatagtatttcttgtaagtggaagcaccagatgcttgaatagattcaggttcaaggttttacaagaatacttcatagatggttatacaagaatacttcagagaggaaaatatttataggtttttgcaagtgtttattcgttgaaaaatttggtttcttaatattttggggctgtccttgtatctgcatcctatgacaatcgctgcctaggattcctacaaggcatccatccagctacaagggtggtggagaaatgagtgttttgttttcccaggctctatagttgaggcagagaagggagaatggggtgtaggctgggtgaacctctattcctaaccccttctccctacattggaacaccccaagcagacttcagggtatctgtatttcctgaatgattaactccaattcaattttgttgcctcccacagaagaaggcatacagtagtgttactgagagagtgatgctattaggacaaccgtgctgactcccctagattttgtttttaatcattgtcagattttggtaattggacaattgttaggaacatattctttgtgaagtcctttgtaactgcttacaactttcatttgaaagctctgcattatttagagatgcagagtctattgagagaacatatctgtaaatacttaactctgagcagtgtgatatatgcagcaatagaaatattttatgtaaaaattgttttcttgattaggagatggttattaatatgagattaatccccacatcattttattttgagaaatttcaatttatcaggaaaatgaaagaatagcataatgtgtaatcttcacatagattcaccaattgttaacaatcacccataaacatatgcataatatacatatatacacacacatatctatattttattttgatgacccagttggggatatattgcaggcatgattataattcatccctaaatatttcagcttgtatctcctaagagtaagagcattttcctacatttccacgttactgctaacatactcaagaaatttcacgttgataccactattttttaatacctagttgatatccaagtgttcttaattatgataataatctcccttttctctactgtgttttttgaatctgggagtcaggcttttgttaccctgtcttcttagttccttttaacatgatacaaatagattaatctgccatgaaaaagtgaaaataccaaatcttggtgtgtgatgagaaatgaactcatggaacagtactagacttgtgtatcagcacaacaccttagtatagatttatctgtgcctatttcctgggccatattttataatttgattaatattgtcctttgggaatccctgatccaataggattaatgtccttatgagacagcctcaacagagcttgctctcattctccctctgccatgtaaggacacagtgagaggacagctgtctacaagccaagagaagaaacctgaatgaaacctatcttggtggtacttgatcttagactttccaacctccagaaaagtaagaagttagtttattttgtttaacctaatcagactgtggtattttattaaggcagcccaaacagactaagaccagtcatttgtgtggatgattgacgtggcatgtggttgatgttttaggaaagggtgacattcaaggacatagctgttatcttcaccaaggaagagctggcagtattggataaagcccagataaacctgtaccaagacgtgatgctggaaaacttcaggaacttcatctcagtgggtgagtaactgagcatcagaccactggacctgtgtcctgaaatcatcatttcaaaccacatagaaaactccagttagatcacaaagataaactttgaccactggaaagaaaacacccaagagatgcatgtgcaggttagaaccctgcagttaatgagcttttacagatcaatgtgaggatctggccccttgtgatggatttgtgagggagctctccccaaatctcatacccctggcctgtgggcattcaatgcaggcagtaatccctccctcccctaatcacacatttaggctctcattctttcctcatatttctcagaatgagacataaaattcacacatcaccaagagccctgatctattggatgcttctggagaaaaatcaatgtttatccaatgttttggataaatcagtgttaaaggaacaaagggagaactttgatttggttggcagttacaatagccaacacttactggtatgtagtaagtgtaatctaagtgttggcttatttgattactttttgataaatatctaacctcattttcatttctcagaggttcatatacagttatgtgctacctaggtttatgagatagagatatggtttggctatatccctacccaagtctcatcttgaattgtagtttccataattcccacatgttgtaggtggggcccggtaggaggtaactgaatcatggggcaggggtctttctcatgctgttcttatgagagtgacaagtctcatgagatttgatggttttataaattggtgttctcctgcacaggctttctctttgactgacaccatgtaggatgtacctttgctcttccttcaccttctgccatgattttgaggcctccacagccatatggaaatatgagtcaattaaacctctttcctttataaattacccagtcttgggtatgtctttattagaaacatgagaatggactaatacagatagttattgttattatcccccttttatggacgtattactctgttttcacactgctgataaagacatacctgagactgggcaatttacaaaagatagagatgtattggacttacagttccacatccctggggaggcctcatagtcatggtggaaggtgaaaggcacgtcttacatggtggcagacaagagaagagagcttgtgcaggaaacccccccacctttttttttttttttaagagtctggctctgtagccaggctaaagtacagtggtgctatcttggctcactgcaacctccaactaccaagttcaggcaattctcctgccttagccaacccagtatctgggactacaggcatgcaccaccatgcccagcaaatttttgtattttttagtacagacagggtttcaccatgttggccaggattgtctcaatctcttgacctcgtgatcaacccactttggcctcccaaagtgctgggattacaggtgtgagccactgtacccattcagaatctcccttttaaaaactatcagatctcatgagactcattcactatcatgagaacaacacaggaaagacccgccccataattcaatcgcctcctacagggttcctcccatgacacatgggaattgtgggagttacaattcaagatgagatttgggtggggacacagccaaaccatattatcccaccccggcccctcccaagtcttatgtccttacatttcaaaaccaatcatgcctcccaacagtcccacaaagtcttaactcatttcagcattaactcaaaagtccacagtccagtgtctcatctgagacaagccaagtatcttccatctatgagcctgtaaaataaaaaaacaatttatttacttcctagatacagtgcaggtacaggcattgtgtaaatgctgctgttccaaatgggagaaattggccaaaacaaaggggctacaggccccatgcaagtctgaaatccaacggggcagtcaaatcttaaagctcgaaagtgatctcctttgactccatgtcttgcatcctggtcacgctgatgtaagagatgagtttccatggtcttgggcagctccacccctgtggctctgcagagtatagtctcccttccggctgcttttgtgggctggtgttgagtgtttgtggcttttccaggcacacggtgcaagctgtcggatctagcattctgctgtctgaaggacagtggccctcttctcacagctccactaggtagtgccctgctagggactctgtgtgggggctgtgacatgtgggaattatgggacatgacacttgggaattatgggagttacaattcaagaagagatttgggtggggacacagccaaaccataccaatggatgaaacaactgagtcacagaattaataacttgcccatgattacacagcttataagaagaactaggatttgagccttcctaatctggccctaggtcctgtgcttttaataaataacctcgttaaaccaaagtgtaatctgtagacacaggaccttctacataaatctgcatatccctgcagttgtttctcaaactgcaggataaaaccctcttggtgagtcctgaaatcaaattactgtgtcataactagcaatttttaaaaagcaaaatagattaatagagcagaaaacagaagaatttatcaaaatgcattgcacatcgtatgtaagtatcagctgataaaacttctgttttagtgagcagtctgtgttgatgtccgtgcctattcctactgagtcacaatgctgattttattgtgggttacaatcaaaacaattgggaaaccactgcttaaaacccatctggggcagctcatggtctccctttccctgatactatcttataaactaaagtcactttcaataaaacaacccagaaaggaccttgaaccagaagcagtatccagtgggacttgaccatgatattcatgccattttgaaacccatcttagggtcccaaaaatatgatcatcctcttctgcctcagccccctgtttgttatataccacagtcttgcttccctgggtgccaggccattgacagtgccacagtatctgttccccattctcattcatggctgtttgagattctgcaataacttaaaaggtcagaacttaaggaaatggattatagtatctgagtggtctctatcttttcatgaagacaaagaatcttggggaaaataaaaaggatgtctcttaaagcttgtctcagaggtttacatatgcatccccgcacaacgccaggaccaagtttcacaatgtttatccctatttcaatccccattgcctttttatccccatccccttaaggctcaccatgtacagttgtgcaggttgtacacaaacatacatgatagtcctccatatgacagtgatgtgaaggaagggaagccatcaggagataggacttgcttgtttctgaaacctcttgtgacccttgtgtcccttactctgcccaacatataaaaaacactccatcaatatgtattatttctatacacacatatactacgtaaaatgggagtctttcccataccttttgtagcaagattattaaagtctttttattgaccactcttataagggggaggtgaatttcttccttcataaatttttcctaagatttccttttattcttttttgctgtgtgggggtggaaatgtcttgctctgtcacccaggctggaatgcagtgacacaatcttggatcactgcagcctctgtgtcccaggattaagcaatcttccaacttcagatttccaggtagctgggatcataggcaaaacagaaccaattttcaatttttttgtagagatgcgatctcaccatactgcccagcctggtcttgatctcctgagcttgagtgatcctcccacctcagcctctgaaagtgttgctgtgacaggcataagccactgcacctggccaagatttctcttaatttccctacaatacttgatttctaattggcagctcacaggttagaattactgtggctttaactgtttcccatgccaatagaagccagggacaacttcccaccccatcatatttcattttctcaaaacctctggacaggtgattcacaaattctctttcttctcatgggagatgggattaaaaacaacattttgaatcttcagggaaaggggttaatttacctttctcaagaagagcttcattgctggaagatttggaaacaaaggatccgggatttaagtgtgagtcaggattatatcatgaaccttcaagaacagtgttccccacatttagaagatgtatccctctgtgaagagtgggcaggcatgtctcttcagatttctgaaaatgaaaactatgtagtaaatgccattatcaaaaatcaagatatcacagcatggcaaagcctgacacaggttcttactccagaatcttggaggaaagccaacataatgaccgagccccagaaatctcagggaagatataagggaatttacgtggaagagaaattgtacagacatgctcggcatgatgagagcctcaattggacctcacgtgatcatcatgagtcccaagaatgtaaaggagaggaccctggtagacaccccaactgtgggaaaaacttgggtatgaaatcaacagttgaacaacatcatgcggtccatgttttaccacagcctttcacatgtaataactgtggggtggcctttgcagatgatacagatcctcgtgtccatcacagcactcatctaggagaaaaatcttataaatgtgaccagtatggaaagaacttaagtcagagccaatatcttattgttcattgtaaaacccactcaggagagactccctatgaattccatgaatggcctacaggctgcaaacagagctcagaccttcccagatgtcagaaagtcccctcaggagacaatccctacaaatgtaaagaatgtggcaagggcttcaggtgcaactcctcccttcacaaccatcatcgagtccacacaggggagatgccctacaaatgccacgtatgtgggaaagcgtttggatttaggtcacttccttgtattcatcagggagtacacacagggaaaaagccctacaaatgtgaagattgtgggaagggctttgaacagagctccaaccttcttatccatcagagagtccacactggagagaagccctacaaatccagtgagtgtggcaagtgctttagttcaagctccgttcttcaagtccactggaggtttcacacaggggagaaaccttataggtgtggtgagtgtggaaagggcttcagccaaagtacacaccttcacattcaccagagagtccacacaggggagaaacaatacaatgcaatgtgtgtggaaaggattttgggtatagttctgttcttcacactcatcagagagttcacactgcagaaaaaccatataaatgcgaagtgtgtggaaagtgctttagttacagttcatattttcacttccatcaaagcaatcacacaagagagaaaccatataaatgtgatgagtgtggtaaaggcttcagttggaattcagatcttcaatgttcatctcagagtccacagaggacagaggccctgtaagtgtaaggcatgtggtaagggcttcagtcgtaattcgcacctccttgcccaacagagagtgcgtatagataagacacagtacacacattgtgagcatggcaaagaccttctgactcatcaaagactacatgagcagagagaaacattataaatgtagtaagtcagggttaaattaggaaaacagaagccacactgtattccagataatagaggcttactcagcctgtgggagggctgggggagcaaaagacagggacactgccatcgataatgtcagcctgcagcactggagtgtgccaggcaagggttgcggatttcaagaacttctgtgaagctcccatcaactgctgtatgctacaatggcaaagtaggttactcttgacaaatgggtggtttgtggtagtgtttgtagttagaggtcaaatttccattaaagggtgtgtccaggaaggaaattctaattgggatgattatggtaaggtcttcagtttagccaaagtccttagatttttttagtccccaacagaaaaatactctctgtatgaagaacattcaaaagtgtgctcagaaatgaaactgatgctcttactatgaaagaacattagtactcaagttttccatgagattctctgcacaggcgagaagctctacagaagtggcatttgaagggtgtggcagaggcagtgctgtgtttatcacactggttccatttccttgcaaataagaagactctatttcccagtaacacttgcagttaagagtgtgcccatgtttgagctctagccaatggaatatgagcaaaagtgatataagccactttcaggtctagcctttataaacatcctcaggcttctctattcctgccaaggtgaccttggaggctgcttattccagactgcattgatagaaggtcgctatctgatctgtgttggatttctttttagagtaagaaataaaaattcactgtgtctcaccactgagatttttggtggtttatttgttactgcagcattgcctaggccatcctgactagcatggagggattttatagcaatatgtttcattgtcattggagtccacatacagaagcaacattgtaattcagagttcaaaccttttaagtctttaaggcttgatgtggcagtgcaaccatctaaaatggtatggatgggacttctccagtgataaccttcattcatttgtgtgtacaccaaagagaaatgttcaagatgatatagctgtggtaaaactttactgaaaagtacaacccacagacgtaagaaatctcatacaatagagaaactctgtagtgtgggagctgaataagtttgtcagctcacaccttaaatgtgattaaaaattaactagaataggtgttctgtggttagtcttaataaaattaattgaataaaactaacatttacgaaagtgagcaacaacatgtaaaaaaccaacagtgttaattgcagactgatgcagtcttcttctcagcagcttcctcccaaaattgtcatttaattggggataatagatgaattcgagaggagatctcattgcttttttttttttcttttggaaacagggtcttgctctgtcacccaggtggctggagtacagtggcctgatcatggctcgctgctgaagccttgaactgctgggctcaagtgatcctcctgcctcagcctcctgagtagttgggactacaggcatataccaccactttcagctaatgttttcttttaaaaatttacttgtagagatggggtcttgctttgttgcccaggttagtcttattctggtttcaagcaatcctcctacctcagcttcccaaagtgcagggattacaagtgtgggccactgcactcagcccacaatgtcttttattttttcttcaaaaacaatgtccttttctgttttaattgacttataagtttcttcatttggatcatggtttattcctagtttttcttgcattatattttcctgccagttatagtttgtaaacagaacagccattcaagtgcaaataaaaccatccctgaagtgtcattttcttactgagcaggtggataagagtgaaatattttaaaaattctgtgtcagtagaaatgaggaaatgagtgttcttacataagttggtggggaaaaaaaacaggtacaaagttgctggagaggatcttgtctatatgtatcagatgtacaatgtgcattgtctttgagccaatgatcctgcttctcagaatgtatttttaggatgtaattacatgagtggaaaaaaatggtttcagaaagaaatatgttctaagaattttgcaatgagaagatcgtaaatgacctgaagcttcatgtataagagattaagtaaattagggcatcccatataatggaataacatggctccatcaacaatgatctagacctataaaaatgtccacatattattgtccatgtccaccacatactccagtcctcctacttgcaaacagtaggttagagaaaaaatctgggatacacattatcccaggaagcttttggggtttagaatgggtgcaacattccctcatgacagaatcggccctcagccttagtggaggtgtcccaggcaatcctccagtatggccaggagcagcccttgcatatcacattaagctttttaaatatatgatgctaacaggattgtctccctacttcataaaattgtttgcttttcctcttgtaacaaagtagcatggaaaaagcagaaattagtctagctcccaatcagtgggagccaactcatttacaaatatagatgcagagatcctaaataaatatgagcatgtcaaatccaatgatttgataaaagcgtaacagactctgctcatatataatttatcctaaatatgcttatcagcttctgcctcataacacacacaagaactgagtagctctaaatacaaatttatttagctcatgatgtgtgagctggcaagttcagttgggcttagctgggcagttctggtgtgggacatgctagattatcttaactgggctttgtacatgcatctgcattcagctgatggctcatctgggcctggctgttttatgatggtcatagatgagacaacgaagttctctctgtcaccatggtctctcatcgtccagaagaccaatctagggttggtcccatagtgccagggtttcaagagcaaaagctgtgatctcttaaggccttgtcagagaacaggctcaatgatacttccaccacattctaatgattaaagcaagtcacaacactggcccagattcatgcggtgggattaagacaagataaaaaattttgagatgtaatcattggaaggaaaaagaaggtactatttttatgttagagaataatgttatttacttataaaattcaaatccgcctgtaaaatttgaccaattgaagtctgttttaaaattatcacgtcaaaaaattggtttcatacaaaattggcacatgaaaactcatagcattactatgtacgagtcttttataaaatgtagccaaagtgtttcattcacaataacaattgtgtgcaaagaccagaattgtccaaaggtaattctgggagttccctttgggatgcctaggtggggagctatctggagcctcagactcccacattcttcagtgggaaaagctttacatgagctcaacttcccagcggctttctctttctgatgggaggtgttagaacctggctttctcatgcaacttctgtgaagctctgacaactaaagccagattgtctgctttagtcaatctgttagatcaattagtcatttgatctgacaactaaagccagattgtctgctttagttaagtagtccagattacctgcatagtcaatttgttccctcaccaacatggatgccttcacaattgctctttaagaaggataaaaagataggggtgaggtgtggtctatctcctgcttcacccaggccctggtgcttcttcaagtagcgtgagaaattgtggtcctgtgcgttctcttccagacccttagcttatatgttttccctataaaacttagtcctaatcccagcactttgggaggccgaggagggtgaatcatgagatcaggagtttgagaacagcctggccaacatagtgaaactccgtctctactaaaaatacaaaaaattagctgggcatagtggcaggcacctgtaatcccagctactcaggaggctgaggcttgagcccaggaggtggaggttgcaatgagccgagatcgcaccacagcactccagcccaggcggcagtgagagactctgtctcaaaaaaaaaaaaaaaaaaaaaaaaaaagaaaaaaaagaagtcccttatgtgtgatgataaaatttgatgaagagcaacattggtggacttacactaccagagatcaacatttattataaatgttctataattaatacagtgtagtattagctcaggagagaaaaaatagatcaatggaaaagaatagggagtctaaaaacagatccacatgtatacagtgagtcagtttatcagccttgaaatatgttggagaaataatagtcattttaataactgatgctgggttcactggctacttaacactagttcttcatacaattgcaggcaataaatacaaatagcatgcagccggcagactgggatcagtggctatgcctccactagactgcccatagaagcacatagtaacagctaccaaagatgtctgatctgtcttgtcttttttttaactcattttgttcaggtatcatttacataaagtgcagactttaactacatttgttttaacaaatgtacatatccttgtaaataatgcccattcaacatgttaaacattttatttacccccaaaatttcccttgtgccctttcccttcatttctttccaaaaaaggatataatcactgttttggtttctatcaccatatgttggttttgcctattcttgaactttatataaatgaaatcatactgtaagatactcttgtatttggctttttttcattcaacatggttttctaaattagtaatttataataaagagtactgcatattttattattgtttataaattgtgttctaaaaacattctatgttagtaaaatttatagtaaacttctataatgtacatacttttctttctggagagccatttattaaacatttattagcataccactcacagaggagatgtaaccccagaattggcctttttcttctgaagtcaactggctttgaattagaatgtaacattagttattattcctcattccccactcattctctgtatctacttcccttattttttttcttttatttttctgcagacactatggttacttaagtatctacttctctttttctgcatgtctttgagtggagacactggtcatctttgtttcccactgtcttttcaaaggtgcatgttagggaacaaaaatatagtgtctccctctggagcagtagatttgtttatggcccactctagtgaagacagtgtctccctctagggtgaagggcagtggttttattcccacgggctatcataaaagattcaggtttcctaagcttaaggttctattcttacaatgcagcctgctaggcctgtggcacctggcctttcatgtcactctatgggattagaatgccaaaaaccattgcaaagaatgacactctggctactgctgtggttgtggctaataaagtcctttgtctcagagccaggagtcttttgtcttgtgccagcatctgtgagactgtcaggctaacttgtgagctcataaattggttactttcagatccttggtttttgatggaaataaatgtctcttaatctcataggcaaactagagctacctggaatgctttcagctttttacaattttttactggtgaaatatacataacatgaaatttaccatctcaaccatttttaagtgtatagcttagtagtgttaagtacatttatattgttgtaaaaccaatctccaaaactcgttttatcttgcaaaactaaaactctatcccattcaacagcaaccctcaattttcccctgctcccagccactggcaaccactatactttgtgtctctatgcatttgacttctctgggtcacataaatggaatcatacagtatttgacttttttttttttttttttttttttttgagacggagtctccctctgttgcccaggctggagtgcagtggttccatttatgctcactgcaagttccgcctccaggcttcacgcacgccatcttcctgcctcagcctcctgagtatctgggactacaggcacattccgccacgcccggctaattttttccatttttagtagagacggggtttccccatgttagccaggatggtctcgatctcctgaccttgtgatccgcccacctcggccccctaaagtgctgggattgcaggcgtgagccaccacgcccagcccagtatttgcctttttgtgactggcttattaactttccataatgtccttaaagtttatttgtgttgtagaatgtgtcagaattttcttcctttgtacacttgggtttcttccacttttcggctattgtgaataatgctgttacgaacataggagtacaaatatctcttcaagaccttgctttcaattcttttggacacatacccagaagtggaattgctggatcacatggtaattgtattttcaattttttcaggatctgccattctgttttctatagaagctgccaccatttaacataatgtttttaagttcatttatattattatgcttgtcagtcttctttttatgttcagagtaatcaggaaattaccacagtttgcccattctcacgttggtgaacatttgtttccaggttttggaaattttgaataaagctactaagaatattcttgtattagtgtttttgcagacatatgctttgatttctcttgggtaaatacctaggagttgaattgctgtcataagctaagtgtatgttatctttatgaagaattggctgtccttgtctattaacataaagaatgaggtactttattgttcacttaaaatctttatgtggttgggctctgtggggtggcacataccagtaacatacctgtagtctcagctactggggaggcagaaggatcacttgagggcaggagtttgaggctattgggtgctacagttgtgcctgtgaatagccactgcactctagcctgggcaacttagctaaaaaaatttatgtggttaaaatttcaatgtgtttatgaaatttttgtataacgattttttaaaagaaaactttcccatactcccaggaactaattattttcaaaacatgaagaatatgttttaagtggtatcaggcacaaatctaattttaattttttctaattggatagtcaaggctttcaacatttattgatgagtcccttttttatttactgatcttaaaggtcacatttatactacactaggtatatccattcctggagtctcctatcttttatgtttatcactgaaatctctgaccatttttttttttttttttgagatagagtcttgctctgtcaccaggctggaatgcagtggcatgatcttggttcactgcaacttctgcttcctgggttcaagtgattctcctgcctcagcctcctgagtagctggcattacaggagcctgccaccgtgcccagctaatttttgtatttttagtagagaggaggtctcatcatgttggtcaagatggtctcctgatctcatgatccacccacctcagcctcccaaagtgttgggattacaggtatgagccaccatacccagcccatttttgtttattctcaaaccactatctcacatctttaagaatgatacttttggtacaaggcaagtaacagtgaatatgctaagtgtatgtttaactttactatttctaaaaatgactataccacttcatacttccattagcagtcaatgcaagatcacttgttctacatgctaaccaatacttgggatttttagtcattgggattatttgtagtgttatctcactgtggtttaattagcatttccctgataagtaatgatgtggttatcagtcattttatcatgtgctgattggtcattttatatcttctttggaaaagaacttttgaaagttttgcttccttactgttgagttgtaagatttcttaatatagcctagatacaaatcctttctcagataaatacattattaatattttttcctagtcttagcttgcctcttcattttgttaatgtttttaagagagtaagttaatttgatgaagttctggtttatctttttaaattagattttgtgctcttttttgcctatgaaatctttttttgcctatcccaaggttttgaaaatgttctcctatattttcttgtataacatttgtagttttagcttttcatttaggtctgttacctattttgagttctttttgtgtatgacgtgaggtaagtgttgaggttcataattttcgaataggtgtccagttgttctagtgctattttttgaaacaactttctcccattgaattacctttgtggctgcaccgaaaataaactgatcatatatacttggctgtattttctggaatcacttctgttccactgatttatataaatattgttaagctttcactatgtcttgactacaggagctttagaataagttttgaaatctgatactgttattcctctaatgatgttcttccttttcaaaacaattttgactattctagtttttttagttggctgttttttgcatatcaatgtaaatcttaatattagtttctgcaaaaagcctgctctaaatttgattgatactgtgttgactttatagatcaatttggaattccggttctgggtaagatggagtaagccagtggctgggaaattctggcctaatggttaaatatggtgtattgactgtttttgtaggcccccatgaagtaataatggcttttacattttttattgagacagggtctcactccatcgcccaggctggagtgcagtggcatgatcttggctcactgcagcatcaacctcctgggatcaaaaaatcctcttaccttaacttcctgagtagctgggactataagcatgcaccaccatgtccagctaattttttgcatttttgtagagatggggttttaccatgttgctcaggctggtctcaaactcctgagctcaagcattctgccctccttggcctgacaaagtgctgggattacaggtgtgagctatcacacccagcctacatttttaaatagtcaaaaaaatcaaaagaagaatattttatgacatatgataagtatgtaaaattcaaatttcagcattcataacttttggttgaaacacagttatgcttatttgtttacatattgtctatggctgttttcctgttatattggtacagttgtgtacttatgatagagaccatatataatgctctcatcacttcatacttctactcagtgtatcataaatcacagtaacacagttattacaagttaacagatttttgagtgtcatatgtatcactctactatgatattttatttattatgcatattcgtcatgtcaaaacaagaagagaaaatcaaattttgaatgtcatgcttttaaggtatagtaaagtgtggattattttgttatagaatctgacggctgactattgtgtttgttatgcagtgacagctgtacaagaagaaaaattataacattaatactgccagattaaaaacttatcccaatatttccaaatcacagataattatggccaaaaataaaaaatttaaaatggaatatcttatcaaagcagaattacttttatgaaataacaaatgaaaatgaggctataaccaaagtaagttttagagtggctaatctgttagtcaagcaagaaaagttatttactgatgatgagttggttgaatcatattttgcagcagctgaagaaatgtatcatataaatttgtctaagactataagccttttgacaaggacagtttcttaaaaagttgagaacattgggagcagcactgatagtcactttaaaaacaagataataaaaaattcccaattattgttgccagtgatagtgaaaatttatcagccataagtgaacacaaaacaaacaaaactgaaagacaaaattataagaaaattaaaatgagaaaaacagaggatcaacaaatttctattgtcactttgtatttacctctgggagccaagaaacaatgcaactgggcttaagaccatcactgaggtgtacttttctggtgacaaacattacctggatttgttacatgaatctatttggcatctctgtgggacccccaaaactgttaaaaaaataattttcaaaaaataaaatcataactcttacacaggtatgaaaagaccagctagggaatgataaactatttgcaaatcatgtatgtgtaaaagtcttgtatagagaacatataaaaactctcaaaactcaataggaaaacaatccaattttttaagctaaaagatttaaacaagcacttcactgaaaaagatatacgtatgacaaaggggcacatgcaaagataatcaacatcattagtcattagggaaatataaatcaagaccacagtgaaatataactacacatctattagaacagctaaaaaaaaaatagcaacaatgtcaaactctgacaagaatgtaaagagactggaagtctcacaaatttctgttgggaatgtaaagtagtagagccactccagaaaacagtttgacagttccttaaaaaattaaacatatccttaccatacaaccccataacttcaatcctggacatgtactccagagaaatgaaaacttacatacacgaacaaatgcacacaaacctgtacatgaatgttcatagtagctttattcataacggcaaaaaactggaaacaaccaaaatgttccctaataggtaaatgttaaacaaatcgtggtacatccataccgtggaatactactcagcaataaaaaggaatggactattgatacacacacaacttagagggatcttaagataattatgctaagtgaaaaatgtgaatctattttatggttctagttgtataacattcttgaaatgaccaaattatagagatggaaagcagattagttgtttctagatatcaggaatggtggaagggaggggactgggtgtgactatcaagatgtagcaagaaggagggctttgcagtgatggaatagttatttatcttgattgtggtagtagctatatccgtctacaagtgataacatacaactacacatattcatggtatcaatataattccctggttttgatgttgtattttaattaaggacagtataatcattgggtgaaactgggtgaagggtacgtgggacctctttctactatcttttcaatttcatatgaatctgtgattattttaaaataaaatgtttaaaaaataattggatgcttaggatctctatagaggattttatttatttctgccagatttacaagcaatacagggtcagggattgagttgacttggatttgggtttgaatacctgccaagttgggcctacttcccattcaactttacacctaggatgcagccctttggtgttccatacacaaaacccacgtgatttttttttcttttttttgagacggagtctccctctgtagcccagtctggagtgcagtagtacgatctcagctcactgcaagctctgcttcccgggttcaagtggttctcctgcctcagcctcctgagtagctgggactacaggtgtgcgccaacacaaccggctaatttttgtatttttagtagagacagggtttcaccatgttagccagcatggtctcaatctcctgacctcgtgatctgcccaccttggcctcccaaagtgctgggattacaggcatgagacaccgtgccccaagtgattttttaaaccatggttatccaccccatctttggcaggtcctagactccaactatcagcttctcaggtttttaccttaaggaattggcaaattccacctcaaattttttttgagataaaagtggtctcaaatacctagcttaccttaatggattttttgcagagacaaggtctcacagcattgcccaggctggtctcaaactccttgactcaagcaatcctctcacctcagcctcccaaagtgctggagattacaggtatgagccattgtactcagtctagaatctgatttgttatgatggtttccatattttaatctgtctctttttgcatatatgctgttatttatttttgtctttctcttcagagggaaacttgctgaggatttgcattgactttagttgaagagaatatggtttttgtttccaatatttccagtcccttctatgaagtattgcaaaaaccaataacttgtatttaatctagactttacatcaaatttctactttacagaacatttaaaagagcagaggagaaaatatggcgatgcctttagacaaatccagaatttagacacctaatttgacatttttatttccccagcagttcaaggaaataaaaaatggtggtggtagtgctgtgtgtgggagggtcggggtgggggcatagttttagagtaaatgacttcttggtgagataacaatcaaataaaatggatcaaaatattcggataatgactggaataaaccagctgtaaaagtacttttccccaaaaaaacaggattcaaattgggacgcatattagataatactaagaattgttaattttatttcatgaggtaacgattttgtggttatgttaaaacatcattatttttaagtgatacaaatagtattgggaagggataaggccagggatctactttaaaatatttcagtaacaaaattcaatagtcatagatattgcctgtatggcaaaatgttgggaagtgttgaatttagggtaggcgcatttggtgtttcatgttatcattttctttttttatttttcttttttgtttttgagatggagtctcctctgtcacccaggctggagagcagtggcgtgatctcagctcactgcaagctccgcctttttgtgttaatatcgtaagtttcattaaaaaatttttttcctgcccagaaggaaagtggtaagtacatacttcccgtagtttgacttgttatagttatctggagtccgtctcccatctcaacctacccacctcttcctgaataaccataaattcacacggcttaaacaggtttgtagaaaagatacgttcatgttaaatatgtgaggtcaacgggcaacagaggaatagccaattccaagcctgatttgaacgcaaaaaatttcaagacaggagccattttccatatcatgttttctaaatttcctgccagtacagcttccttcatttttcagatacaacttgctctttctgtgcttgatttcaagactgatttgtccttggaattccttgtggattcttggcatcttgaaatcaattgtccgtgccagatagcataagcagaggtctagatgagtataggcacatataaagaggcaacggagttaaaccacgtctgagattccatattccttatggttatgtccagtggacagcccaactcccttttagaatcttgtttcttctcatactcatcacttttctgctaaagtgtgtttcttttcatactaaaaccttcgcttttatcctcaaatagttatattttctttatatttccacatgctcgttttttcttgaggaaaaaaattacaaaaataaaaagcccaagcgctcatcgcgctagagaagtgaccttcagtttgaacgcgctgaaccaacagaatgagctgcaggaaggcggaagcactagcgtgctgggcattctgggaactgtagtcggaagtattttcacccaggctggtggagtccttgtcgtcgttccgcttaaacattctgggaagtgtgggtcagacgtttcatatagtcgacaacacttcctcttcgggagtacagggtgtggccctctcgtgtgactccagactctgggaagtgagtcgcaggaacttccgctccagggaaagttgcggccatcatgctgcatgtgagacttgagccccagcgacgcttctgcgcctcctcagcctgggtgagggaccaaagatggtcaaggccctctgtcttgaggaggaaaagtggcagccggcggaggattaggattggaagtgtttgcgtttccctcgactcagtagagctttctagtgttaggggaggttcctgagtcccaggttggggaatgaggcagggtcttgcatcattgggtttgatggtttcttgggtcttgtactcccgtagcccttctgttggacccaccaatcagcattgccgcttcctagggaagtttctgtggcgttggaaatattgtgtaacttgatcgtgttggtagttacatgtttgtacatatttgttaaaactcattgaactatacacttaacaatagtagactttataatgtatgtacattgcacttcaataaatgtgactttttaaaagtgtctggaactttattttttttaagtggcaggacctcattacaagtaagttcagaactaagttaggactactataatcctgctagcaccaccctcatgtaaacattttcattttggtttattttatacgtatatagatatttgctttttattaaataatgtgtaaattttaaattagtatttcagttagtaatataccataagttaattttgctgtttcccacattcttcataaagttcatctttaatgattgtgttgtattgaattgagtgaatgtgcacttgttaaacctgggcatctgggatgtgtttaaaaattattctcataattttatgtatatatgaaatgttttacaatttaagagatatatgctgacttccatgcctctgttcatcttttttgtctatcctacttggggtactcatttccatggtcatactataggccttaaattagcaatagctgcaatccctccatagtctccatttaaggcattacactctgctctacatattctcttgccagatcttcctgtggtttactgtgatattgacttcatcaatttctacaattcattgatcctattgcattttcaatatcccttattcatctcatatcctcaataccaaccatatcttttctcttctctctagtataaacagaagacttacacttacatctaattgttcaaaatattgtcctatgacaaccgtagacttaaggaacattaagaaagtattttgattgtcccccatgattttatagaagagacatgcagggtcaaagggattatgaatggatgctctgtgagccagtcaatagcatatgtcccaaaggctacaggttaagtatattacctggcccagcagctttaaaatcatcttttggtctcctactctagacagcaaacttcagttcaggcaccagtgatgctattacgtgaggaatattgacttgcctctgtttttgtttttaaataacatcagatttggtatcagttatcacttaaaagttatttgtgagacactttctcagtgtatgtgaccttggctgggaagcattgctttagaggtgcagagatcagagatcagataactttgataagtcggtatgtgcaatggtagaagtattttaaacatgccatgaaaggggatatttcaattcatagcatctatttttggggaaaaggctcccaaatagtattggctcagtcagtcagatcacttgtttggagatagggttggtaatatgactctatgcactgtgcatactcttagattcaagggtccccattcaaggaatttatattatggtagcactcacttaaagatcaagaacaaatggacatgggtgttcactaaagcatacttttgtgaacccaaaagtatgtgagacaggtctcaatccatttagaacatttagtttgccaaggttaagtacgcacctgtgacacagccttaggaggtcctgacgacatgtgcccaaagtggtcagggcacagctcgattttatacattttaggagaaatcaggcatcaaacagtatgtttaagttatacattgcttaagtccagaaaggcaggacaatctcaaatgggagtgggagcttctacatcataggtagataagagacaaacagtggcattattttgaggtctgattaggcttttactgaatacaaaactcacacgtgagaggtgggtagacgaatagtgacttaggtcttaatgttgcttagtgaatatgcattattacagaaacaatagggaagaggaagcaatcagatatgcatttgtttcaggtgaacagaggaatgactttgagttctgtctgtcctttgtcccacacctgtgaagataagctatcaatttacattaccagggtgaaattcaacagaaatgcttttggataaagatgttcaggcccacagggaatttccttgttgacaaattgtgaaggaggtatgtagctttttcttctttatagctatcatattaagtaataaaatgggaggtttgcctgacacagttcccagcttgacttttccctctggcttagtgatttgggggtcccgagatttatttttctttcacattttgcaagactatggatgcttaataggatgagattagcaattgaaagagaaaaaattttgattcttaaaatcttcaccctttccctcaaactctgtgaaccttgttcttctaatggacatttgtgtgcatgattgaggtgtagtatcttaggtgctgtaggaaacagtaatattcaagaatgtgctgtgatctgcactaaggaggtgatgctattgaacaaggccaaaataaacctacctatggagaagtattcttgccgaaaacgatgaaccttaatcttatctgctctctaaatctaaattgtagtttaccagagccacaaaagatattcaagaaaatgttaaatggcagcataatgaaacatttttaaaaatccataatgtgggacatcttacttgacaactgacctgatgtcttctataggccaaaagcatgaatttaaagtggatcaaaggggggatactcttccagattgaaagagactcaagagagaaaacaatcacatgcaaagaatgggtatttttgagatgactggaaattttgaagttttgttttgtagggtataaaataatattaaggaattattaactttcttcagtgtgatagttgtatttttgttatattagaaaatgtaattctttgaagtatgcatgggagtgtttagggggaaaataatacagtgttatgattttgttttaaaattacaataacaaaaagggcagaaagacaatattgatagataaaggaagtgtggcacatgttgaaaattgctgaatctgggtgatgaggtgatggaatacttcactctttacttctattaatgtttgaaatttttcataatataaaggtatgaaagtgtttagttcttgtccagaagaaaagtggtaagcagaaccttcgtgtatttttatttgttggattttctggatttgcgtccaactgtcaattgactcacctgaatgaaatacagttattattgtatttatgataataagaatagggtggaagtgggtgatgtgatatttgaacttgaacaaaaagaaattccaaatttttatatatttatctcttttcatattataataattcctccacatgaacacacctcctttcatttgcctcatgagccatgttttacaatgaacaattaaagtcaaggaacacccaaaagcttttgctgcttctgctttatactttaataaactttgcatgaccttcttgtgggttcttgtatcatggaatgaatagctaatatctgataacaccgccaagagttctagatgcatccaacacacatggattaaagtagaaaatccagtcaaagtaggtttgagatcttgtgttccttacattcgtgcccagtttctaagttctgcatttttagctcacacatatcttcccctttataatttatgcctccttttcatttcaaactgtgttctctactaaagggaagtgggtgggggacagggtgggagcggtgttcaaatacacttgttttgtcacatgtgaaagaaaaaaaatgagaataacgaaaaagaaggctgagcttgaccagtgagatagaatgattcggactgaacctagttatccaaaataaaaagggaaacgctggtgagaagcgctacctgaagaggattctggaaactggtccaaaggattcacggcgtcaaaaacacttctgttccaggaaaggtggctttaatgattgggcttctgggggaaatattaagtataaattagaatcctgtttttggagacattttggttcaaagaagacagtgctgagtttgcattctgctctagaattgtgtgacatacattccaaattcaaacggtagtagccagccctccgccagagaaaggcaacgacattgccaattctttgcgaggattctgggagcagtaaccttggagctctgtgtaggcggccaggcttccgctacaggagggcgtggctgtgacgattatctcattggggattctggggttataatacaggaattgtgggtaagtacagtcacttctgctccatgaaagtgaggtcatcattcgtttcaggaagttgagtgaggcctgagacagcaatgtttcgtttagcctggcggtggccctccttgtcttcaagaagagcatccgtggctagcagtggaagatggggttgggccccaggtgagtgaccctttgtcgagtttgcagaatttggtcttggcgggttgaggatctcttgtattttgtgcgctctgttcctgctccaggactgaccaggcagttctgccaccttctaggagtgtgaaattgggaagtaattcaaaatgtatgtgcctagcattccttttatgtaacatgaggggaatagaagtaccaaaccgatgcagttcagtggagaattaaatgagatagtcacaagtaaaaggtggtaagtgtggttcattttattaattttcttttaatttcccgagaagccccagttacctgaaagcttctgtgagcctgggaagggatcagagttccacctgcagtgctattttgccccttctttctgatccttacaggaagcaggacgattcctggattccctttttaaaaaagtgagggtggcggtgtggggatgggggtggggggtggggcgggaatcactccaggctactgtatggggatgccctctgtgattcgtgcaggagggagacacagttctggtttctcgcagatggtcacaggaatgaggaaagaatgactctggctcctagcagcagaatcttaactgagtatgacttagcatccttcttcttgctgtgtcatctctcttctcagggcagaagatatttactaattagcacattctgctagcacatctgtgggaaaaggtaggaaggaaggagggagggtgggaaggaggaaagaagatccactccttatactggaaaaaaaggagcaatatacttttcctcaaaatgagaagtcaagcccaaaagaattctgtacagaccaccttaaaataacatctttcaagcctgtctgcatgatttagttgcttcttttttaaaaaaaatttaatttatttttattttgtagagacgcgatcttactgcattgaccaggatggtctcaaactcctggctacaggctatcctcctgcctctgtctcccaaagcgctgggattacaagcgtgagccaccaggcctggcccaattgcttcttaacaacttactattctttgttcactacagtgtatacataactgactttttatttggatcttcattttgtaatgaaggctctggtcacatgtaagacttgtattaaataaatttgcctgctgttctgttaatctgtgttatgctaatttaattcttgagcccagctgggtcctggagaggatagagtgaaattttgtggcagctacgtaagtcaatgaaattggaaacagaaaaacaatctttaaaaatcaataaaatcataaacttattctttgagaagatcaatatagtttataaacctttcaactgactcacccacagggaaaaagaagaaaacaaaaatcaggagggagggaatgttattacaaattttgcggatattaaaaggattataagggaacattacaaacaactccttgtccataaattgatcaatttacatgacatggaatattacttgaaaggcacaaactaccaaagctcactcaggaagaatggataacctagatacttgcgtgtatgtatgtgtgtgcatacatacaatttttacacacacacacacacacacacatatatatatatatatgcacagttaattttttctatcttttgtagagatgggtttttaccatgttgcctgggctggtcttgaactcctgggctcaagcgctctgcccaccttggcctcccaaagtgctgggattacaggcttgaaacactgcacctgcctggcctgatatatatttcaaaactgatttaatagataaagccttccaacaacaacaataaaaaaaacaatattgagatgaattcattggtggattctactaaacatttaaagagtaaagatgtgaattttaaataaacccagaaacaaaaagagaagggaacacccacccacccccagcttgtctcatgaggccagcattaatctgataataccaaacaagacaaagaaattacaaggaaagaaaactacagatgaatatccttcatgaactaagtgaaaaaatcctgaatacagtagtcccttggtatcggtggggaattgtttcagggacccttatggaaatcaaaatccgtggatgctcaagtctgttatgtaaaatggccataatattctcatgtaaccttttcatatcatcctgcatacttcaaattatttctatccctatacaataaaaatgccctgtaaatagttgtcatactatattgcattttttatttgtgttatttttattgttgtgttgctaatttgtatttttctctgaatatttttgatccctgtttcattgaatctgtggatgcttctgtagtatccactggcatgaagatctagatgacagagattgaggtgaccacaggacctggaaagtgagggaagaaatcctgggaaaaagatgtcaagcaaagaattgctccttattctacattaaactctgcccaaatttcagactgactgacacccagaatgtataaagacttgtacaattcaatattaaagagcccaacatctcaattataatgggcaaaatttgaacagttactttacaaaggaagacataaaaattgttaatatagcctgtgaagaagtgtgacattattggtcatcaggaaaaagcaaatgaaaactgcagagagatgcaactacacaaccaccagaatggcagatattaaaaatactgatagcaggccaggcgcggtggctcacacctgtaatcccagtactttgggaggccgaggtgggcggatcatccaaggtcaggagttcgagaccagcctggccaacatggagaaaccccatctctactaaaaatacaaaaattagccaggcatggtggcaggtgcctgtaatcccagctactcgggaggctgaggcagaaggattgcttgaacccaggaggcagaggttgcagtgagccaagatcatgccactgcactccagcctgcatgacaagagtgaaactccgtctcaaaaaggaaatattaataacagcaaatgcttattaggattcaaaacaatcagaaattgcatatattttgggagacagtgtaaaattaatcttttgggagatgatctggtgttttcttaagcagttaaacacaccaagcaattctaatcacagatatttattccagagaaaagaaagcatatgaccacaaaaatacttttataagtatgctgcaggatctttattcataaaaatatttagacaattaaaatgtaagcaagtttccaaagacatatattcatgcaatagaacatcactcagtaataaaaaggatcaaatgactgatatgtgcatcaacatggatggatctgaaaaacactatattcaaagtattgtaatgcagaagagttcttaccatatggttccatatatttcatattctaaaattagtaaaatttatggtgaaaaagtggaacagtggttgccactgggggaaggggttagagattgactggtaagtgtcatgggggaatctgtcaggtaatgctaatgttctgatggataagtaataagtaagatagctagatggatgactaagacataaatgttgctaattttagaatctaagctgagaatatatgggtgactactgtataattcttccaactcttctttatggtataaaatttcagagctaggcacagtggctcctgcctataatgccagcactttgggaggccgaggtgggaggatcacttgaagccaggagtttgagaccagcctgggcaacatagtgggaccccatcttagcaaaaaaaaaaaaaaatagccaggtgtggttgggcacacctatagtcccacctactttggagcctgaggtgggaagatggcttcagcccaggtggtcaaggctgcagtgaactgtgatcatgccactgcactctagcctaggtgacaaggtaagatcctgtctcaaaaaaaaaatttttagtaaaatattgagaaaaacctagttttgagtgaaaaattttaacagagttttataacacaagatatatatatatgcatctgaaattccatacatttgccaaaaagacataccagcaacaggcacacattaaacagatcgacctggctactgatgctacaggggagaaaatgagagtgggtagtgggggatataatggaacaaataaataatatctgtttgtttttttctttctatgtttaatatgtaagccctcaaacattcccctattcaaataaatgatatttttatgttcacattttattcagtatttctgtgtaaataaactaggaagacggtctgtggaagctttatctgtgttgttgccaaaggcctgtaatatgtcttgaagaatattttccagaaagaatttagaagtgattcacaactgaatcttgtatgccaagaatagtgcacatgaacaaaacattctctgaccatagaaggatcaatcttttcatctcaaaaccccatagattatttttatattttattactacttttaatgttgcagacaataattaaaatgaaaagcttattttttcattcctttgaaattgactcaattctttagtcttcagccttgccattaaaaaaaattttcagtgtctacaagtgcatctctaggagtctcttcctcctttttctcttactcttcctctcctacttctcctcctacacaccctggccttccacccacttctcctccatcttcttctcctccttccaatatgtgattttgcccatttggataaattgtttattctcttttaatgatttatttattacaatctgcttccttctctagtccacattttttctcattagcttataagatacacctgatcaatatgttcatattcattatagagtttctcattatttttagcccttccaagttctgaaaaaagttctatgccatatattcagtttcctttgaaacatatcattgattttttaaaaaagactttattttaagagcagttttagggttacagaaaaattacagagaaagtattaatatttcccatgtgctctcctttcccctgcccagtttctcctattgtttgcatcttgcatgtgtgtggcatatttgttacaactaatgaacgaatatcgacacattattattaactaaagtctgtggttgacattagggcttactctttgtgttgtacattccatgggttttgacaaagcataacatcctatatccaccataccatatcatacagaatagtgtcactgcttaaaaataccctgtactctaccaattaatctctctgaacctctaacaaccactgatcactttactgacctttagttttgccttttccagattatcatatagttgaattacagtatgtagctttgacagactggcttctttccattaacaatatgaatttaaggttattctatgtgttttcataacttcatatctcatttctttttatggctgaataatactctattgtattgatgtaccacagtttgttggtcatatatcattgatttttacagattgaaatatcacttacattcagaaaagtgtccaaatcataaatacacatgtgaaagtatgaacataaaatgaacagctgtataatcaccactcacagccaaaaatggagcatggtagaattgcaaacaccccactctcacagcatcatgatgctttcttccccaggaaaagaaaccactaccctaagttttaaggttcccttgcttttctttatatttttactatttaagtgtccaaaatcatcctactgatgaattttgcatgtctaatgaacaagtggaatcacgctgcatctacggggtttgtctagttattttgctcaacatatttatgggagtcatcatggtattgcatgtacagctaaagtttgttcagtgtccttgctcttaccttgtgtaaataacaaaaaatatttatccatactatcatcgatggacatctgaagtattctcagcttgtcattgtgatgaatgatcctgctatgaacattcttatatgtgtattttggtacacatttcttatgggtttatacactgagtagatttaagtgtcataagaaatgcttttcaaattgggctctacaatccaccagccttagattgttgcatgtagtgggaggtataggtcaatttcagttttatttcacaatattcaatttaacagcaacatgtgttgaatatttgtcctgttcccatggtgctgcagtgccacatttgttgcagatctgaagtcaacatgagcatgcatataaaattcaaaagatctacacataaaatattaaaattaattagattatttggcaagattgcaggataaaggagcaaatgtggtatttagtagaaatggttggagtggacatcattatttcgttccccatcgtagaggaaatgttttcaatatttcactattccttttggtatttgttgccatttttgtagatctttactattgcttagttgcctaaattttcttatgacaaatgggtgattaatcaaactttttttttctgtttctgatacctaggtcatgatgtgttaccctcatatatgattggcaacattttgtttaggatttttgaaagtatatttatgacgagatagacctgtcattttctttttctttcttttttcttttctttttttttttttcttgagatggagtctcactctgtcacccaggctggagtgcagtggcacgatctcagctcactgcaatctccacctcccaggttcaagtgattctcttgcctcagcctcccaagtagctgggaatacaggcgcgtgcctccatacctggcttttttttttttttttgtatttttagtagaaacggggtttcactgtgttagtgtttgccagaatggtctggatctcctgatctcatgatctgcttgccttagccccctaaagtgctgggattacaggcatgagccaccatgcctggccagacctgtcattttctattctaatgaagcctctcacaaattttgtcagtgttattatagtggcctcataaagttagttggaaagtgtttcctattttgttattctgaggaataattttgagatgaacatggtttcttctttaaatatttggtggaattcactgatgacaccagatttcaatgccatactcttttatctatggattacttaaaagtggtttgattaatttctaaacaagtttataatttagggttcacctagaagatagaaaccttacgaattatttgaaaagaaaaattagcatattgtagagttggtagctagatttctgaaagagcagaaaaagaactctgggccagatgctgtggctcacgcctgtaatcccagcactttgggaggctgaggcgggtggatcacgaggtcaggagttcaagaccagcctggccaacatggtgaaaccccatctctactgataacacaaaaattagctgggagtggtggtgcatgcctgtaattccagctatttgggaggctgaggcaggagaattgcttggagccgagacgcaggggttgcagtgagccgagatggcaccactgcacttcagcccggggaactgagcgagactctgtcaaaaaaaaaaaaaaaaaaaaaaaaactctaatatatgatggaagtagcaactgcaggaagtagcaactgcagcaagcagcaaccacctgaggtctgaggaaacaaagtgaagagacaggaattactaaaacttagaagcttggaggaaggtcatgctcacctgaaactcagacctctaaggagaggccagtgttcagctggctctgctgtctctgagctcagaaacagggccctgcagttttagcacttagacatctaaggatcagtctttgggaagttgtttaataatgtttataaagagccatgatgaaataggtattcaagtgttagaaaaactgaaaattaggcagttgctacaagaaaaagtactgctggctggcaggcacaggatacagtatatctccctgcccccaccacccctatactcttctgctaatagttgccgaacacagaaccagattgggggtgtagaggtcgggaaagattggctgcagactcccccattccagccccataaagcggcgtgaagaatggtgggtttggagatgagacaatatttattaaatgcacacatgaatcatttagttgtatttttattgatttctagccaaatttcactgtattcgaaaacatagtatttcagtattttgaaatcccatatcattttactcatttgtacaaatcttatgtgctcttgaaaagatgtgcattttaatttttgctagaatctttctttcccccagcttcatataggtgtcaaaagtgctgcagagattctaggcttttcagatcctagactagaccatcatccccaggagaaaattagccccaaatgcatgactctcccaactgtttctgaattttggcccaccatttctccattatcttgtcttttgatgtcttttgacatttaaaaagtttgctcacctttcctctgctacatgtttgttccaaatcactcattttattattactagaagtggaagtatacaaagtattattctgtcccttttatttttaaattttcctttcatttttttcaaaaaaatcacctattatcagattgatcctctttaatatgtaaaccgtatggattttcaaaaacatttccttggaaaggagttaaataaagaatcaaatagtctcatctcttaatagtgtcttttaagccactgagcgttttcacagattggtcgttatgtctttttattttcctcttccttttctggattgagtcaacccattcaccgtcctccctgagtcatcctccataagacaacttacaatatttgctatatcaagagcagggtgaaaataggtgatagatttttctcaaagaagaaaaaaatttcaaggttttacaagggacttatcccttctcataataataacattttgtctgtatcagtacagcccttctatttgccttatgacttgcatttcatcatcagtagttaaagcagaggaaacgtgggaaccgcttgctgtttctgtttatggcctcatcaacggttgcatctgtttttttttgtggattcttggcatccacgttcttgtggatcttgcaacaaacacattatggtaggtagcagcagcactatcagtttcagacgcgtccacaccaaaatggaataaaaaagtaatccagtcaaagaaaggttgagatcctgtattcctcaaattcggtgtccagtacaaatcagcccaatttcctttgagtacctgcatttttagagcacacatcccttccattctgtaattctttttttttcttcctgtattgcaagcttctccgttctctcctttgtgggatattttcttggtaggtaggtaggaaggtaggtaaagtccgctttggttgagtttatttgggtttgtgtagcgtttgaaaaaaaataaattcaaactctagggggaagggagtagagcttgactggcagtataaaattagacggctaaccaaaagagaatagtgactatacaaatactgactatccaaacgagaaagagacgacttaaggggaagtgctgccctgcaagaaattccgggaattgtccagaagatccacagggtcagagacacacgcgccaaaaaggcgcctttcatgcacggtcctccggggaaaacagagaaatatatataggagctctctgcctttggaagcatttcggttccaggaagggagagttaaggaattcctttgggaccggcacatgtgaaatatgatccaggctctccgcttggcaccctgcacttgcgtcctaggcaggcagagagtggagagtttttctaggaattctgggaagtgtagtttgggagccccgtgtagtcgggtaacttccgctctaggaggctgaggccgtctccctgatcccgtcgagaattctgggaagcgtagtccaggaggtctccgtagggagagccacttccgcccaaggtacgctaggccgcggccttcttttctcccagaaaggtgaccctccccgccctgcgtcctgctccttccgtccatactgatgtttgttttgctggaggccagtagcaactggacagtagctctaggggaggagaatccacctgcggcgaagggtgggatttgttttctttgagccttctccagtgtggggcagctggcgcatctccacttagcgccgggggtccgggatcctacatcgcagggactggggatctcctgggttctgtactcccccagccctttcccctgaccatcagccagctctgccatttcctagcagtataataaaaggcgagtatcttaatctctctgcctatgtttctttttctttaaaatggtactagtatctatctaatggagttcttttgagagttaaataaaaaggcttggaacagagcctgacaggtggtagaagatgggtctcttgttattagcacgttttaattttctgagaaggactcagttccctgaaagcttctgtgagcccaggatggggtcagagctccagctgcagagtatccctggcccttttctgatcactgagagatttttctttaggagaggatcactccgggctgtctgggcagtccactgtaattcatgcaggagttctgatttctcccatcctcctttccttctttagccttgacttcttgaaaaaggctgcagggagaaggagggaataaccctttggcacttggcagcggagtctcacctgagtagtacttatcatccttttttcccagggagacaatatttccttcattcattggcaaattctgctcgaagatgccctgatatttgttcaataaatgcagaaacggatgagggagaacttgggcatgagtaataaagatagtatttaaacattgagtgctgatcattcttagagtttgatatgaattaacatatttaatcctcacaagagccctttgaggctgggttgggtgccaccattcccatcttaaagaaaagcaaagagacacacagcataggtggtttacctttaggtcacccaggtggtaagagtctgagctgagatttgaattcagatagtttccatcgattgccttagttcttgatgtgtttagtgtcagcttcagaagacatgtttggatttttctagaggaccgtaaaagcgaggttaatgagctttgaattttttattttttttagttatctgtaatttaattttatttgaaatatttacattcatattctgattatataaatgattgcatattgtaaaagattaagaaagtatagaaagagtaaaagaaactaattatgctaaccacaagatataacaataacaatattaattcaatgttttcctcttccagtagacttctttttggatttttacccatgtttaaccaaataggcttcatagcttttatttttcccttaagtttttactatggaaatttataagcatagtcaaatgtaatatgactaaaataattctgtggaagcatcacccagcttcaaactttgttaacatttgccagtctcggatcaactccatgccccttttttttggtttcagtattttaaaccaaatctctaacatcgacttagtataatattgtttgattgattgtcataattgtcaaacattgatgatcataaattgcttatatccaagaccgtgaaagggaaatgccggcagctactctaaggttttcattcgttgcagcttacagaatggtccttattgaggacgctaggggacgcaagagagttgtaccttggagaagaatggtgctgaattttgtgttccagtatagagtttgccttgcctaagtcttatagctctttgtttcttatttctctttatctaagtccatacactggaagttcttctatttctgggaccatgtcatatttttctctatgtgtccagcacatcgtacaaagttgttaagtgtttatggttagagtagctactcaacagacagctggcatcaaggatttgcagtgtagaattggaataggtatcaaaatagaatagaaataacccctggatatattccttaatctcacttaatattggtaggttatataatccaccaactatttcagagtattgaagagttgaagagcaatgattggttatgtttcgataatctaaaaaaaaatccctggaaacaaattgttagaaatgataacaacatttatagaccataccttataactgagattgtgtttccaggtttttaaaacaggtttttaaaaaatgtttctacagtaaaattgactattttgttatttttggtgtacaattctattacaacacaggcatagtttgtgtaacgactaccgtagtcagaaaaagaacatttccatcaccccaaatgtcttccctcataattacccctcaccatacctgtaaccactggcaactaccataagcactaaaactctacagctttgtctttttgagaatgtcatataaatggaccgacgctatatgtaacatttgagaccggattcttttactcagcaaattggtcttgacattcacccaagttgttatacgtatcaatacttcatttctgtttacttctggttaacggaagtatccacttcatggatatatcacagttcatctattcactggttgatagactttttcccccactttttggcatttatcaatagagctgatataaacattcatgtatagtttttttgtgcttatttctgtagcatacgaagccaggagtatgtttactgggtcatatgggaaatgcatgtttaactttataagaaactgccaaattgtagtatctgtaccattttgcattctcactaatgatgtagaaagttccagtttatttacatcttcatcagcacttagtattttccttatttttttattttagccattctaagcattgtgagtttaatttacatttccctaatggctaatggtgttcagcagatattacttttttgttgttgtttctttgccatccttatatcttctttgcagaagtgtctgtatgcatgctttgcccagtttcacattgggttatatttttcctattgttgatttttgagagctatttatatattctggatataagtctttttttagatgtgtgatttgcaaatatttcttctcagcctgtagcttgtcttttcattctcttaatagtgtcttttgcagaacaaaatttctaattttaatgacatctgatttatcgatgttatcttttttggattgtgcttttgatgtcatatctaagaagtctgcctagccccaggtcatgaagattttctcttgttctagacgttttatggttttacacttaaatctgtgatccattgtgagttaacttcttaataatatgcgatggttaagttggggtttatttctttacatatgaatgaccaaccatcccaacaccacttgtttgggtttatttctgtactatgttctgctaaattgatctatgtgtgtatctcttcaccagtagcaagatgtcatatttactgtagcttgatagtaaatcttaggatagtttgattcctccaaatttattctttttttccaaaattgtttttagctattctggttcctttgcctttccatataaatggaatgcatgcctttccatgcattttagaatcagcttatttatatctacccaaaaattcagctggtattttcattgacattatgttaaatcagaagatctgtctttctcacattgagttttccagttcattaatataacaagtcccttcatttaagtgttctttaatttcttgctttagtgtttcatgattttctgcatacagatctatacgtgttttgtttagacatatgcccaagtataatcagccaactggtcttcgacaaagtaaacaaaaacataaagtggggaaaggacacccttttcaacacatgatgttgggataattggctagccacatgtaggggaataaaactgcattctcatctctcaccttatacaaaaatctactcaagatggattaagaacttaaacctaatttctgaactataaaaattctagaagataacactggataaacccttctagacattggcaaaggcaaggatttcatgaccaaggacccaaatgcaaatgcaataaaaacaaagataaatatctgggacttaattaaactaaagagcttttgcatggcaaagggaacagtcagcagagtaaatacacaacccacagagtgggacccctgaccttgaccctgaaccctaaccttgacccctaacccctgaccctaaccctaacccctaaccctaacccttaaccctaacccctaacccctaaccacaaccctcaccctcaccctaacccaaccctaacccctaatacctaacccctaacatctcttaacccctaactctaaacgttgactcctaacccctaactctgaccccaaccgctatctccaaaccctaaccctaaacttaacccctaaccctaacaccaaccttaaccctaggttcgttgctacgttggtattgactatgtcaatgttgattattatgatctctgtcttaggactgcacggcagcgaggggattgcggatcttatattaatatttttgtattgaggcagtgcattagcattacaggtgcttgttacatgagcaatggaggtgtcatattttgggtgtcatgtctgcattaggaatgctgcatttgtcttccgaggctgcggtgtggatctcgcactgcggccgcctcgccttggctggggagaacctcggtgggcaggattcagaggggattttggtttcccgttttccacattgaacccctctaactggtctctgaccctgattattcagggctgcaaacaggaaggattctattcaccgtcgatgcggccccgagttgtaccaaagcgaggcagtgcccccaaggtctgtgctgagcagaacgcagctccgccctcgcggtgcccccggcccgcccgcccgggtctgtgctgagaacactgctccgccttcgctgtatctccgaagtctgtgcagaggagaactcagctccgccctcgcgatgctctccgggtctgtgctgaggagaactcagctcagccttcgcaaaggcccagcgcccgcgcaggcgcaggggcaggaaggagcccagcagcgaggcaggtggcaccaccaggggggccctcaagcctggcgcgcacgcattccagacgacacccagaccatgctccgccgcctgggcgcccaagctgcagtcgccctctgtgtgcaggcagcagctgcctggcaacccccgagcccgctcgcgctcccagcatcgcagaaccagggccaggtatcccagtggctgcgatcaagccagtcattctgcccggcggcggcggctgcacaggagccagaactgagaacccgccgctcagccccacacggggtgactgccgagtgcccgtgccagcggcccagatctccctcaggtggaggagtgggcgagaggcacggcctgggggccctcaggctgggcgcgctggcgatcccaaggccgaccaggccatgcacctccagcccgcctgggcacctaagctgcagccgccttctgtgtgcaggcagcagcctccaggcaactcccgagcccgcccgcactccccacatctcggaaccagggccagatgtccctgtggctgcggcgaagccaggcggtctgccctgcagcagctgcacgggggcgggaaccggccctcagccccatccccggtggctgtagaggacccctagctagaggtctcgagctctggcagaggaggacccgggcgggggcagggtctggcgggctctcaggccaggggcactcgtgatccagaggccgcccaggccatgctccaccacctgggcgcccagctacaggcgccgggcaacttccaagctggctggcgcgcccagcctcgcagaaccagggctagatgtcgccgtgactgaggccaagtcaggcggtctgcccggaggcggctgcaccagggcaggaaccgaccctcagccgcatccccggtggctgcaggcggcccctggagcggccccgatctctcttcggaggagaagaggggcggagtcacggccaggcgggccctcaggagggaagggatgagcgcctgcgattccgggaagtcccgcgccagcccaggagaacccgcaagcccgcggcgcctgtttctctgtgtgattctttgaggaaccaccaaactgttttccacagcaagtgcatcattttctgttcctagcagccagttcatgagggctccaatttctccacctccttagcaacactgattttctgtatcgttgttatgaaagccttactagtggatgcaaagtggcatctcatttgggttttgtcttgcattttattaatgaataacggtgtttagcatcttttcttgtccttcttagacatttgtgtatcttttttggagaaatgtctattcaagtcctttgcctcttttttaattgggatcttagaaattctgttgagttgtgggatattaagcttttatcagatacacactttgattttagcagatacatattttctcacatactatgggttgtcttttcactcccttgatagtatcctttgatgcataaagggtttttattttgattgaatctaatttacatgtattttcttttgttatctgtgcttttctgtcatatttcaaaatacacttaaaactcaaaggtcataaaggtttaccgtgtgttttcttctaagagttacatacttttagtccttacatttaagtcttttattaatttagaattaatttttgtatatactgcaaggtaggggtctaatttctctcctgtgcactgacatccagctgttgaagagactgttctttcctcccttgactagacttggccaccttgttgaacagtcattgaccatatatgtgaggactaatttgtaggatctcaaatctgttctattgtattggtctaaaagtctgttggtcttatgccagtaccacactctcttgatgactgtagatttgtagtaggctgtgaaactgaaaaatgtgagttttccaatgttctttttcaagactgttttgtctgtcagatcctttgaatttttgtatgattttagaatgagtttctttgtttctgcaaaaatgcctttgggattttgatggtattgcattgaatctgtagattactttagatggtattgtcatcttaacaatattgtcttacaacccgtgaacacagaatgtctttccagttatttccactctctttagtttttttcagcaaagttttgtgttccaccatggttacatttatgcctgaataacttattctttgatgctattataaatggaatttttaaaatgttttcatagttatttacaactaaatagaaatatagctcatttgcctatgtttgttttgcatcctgcctcttttattagttataaatggttttgtgttttgtttggagctttatacccataagatcatgtgtagatataattttacacctattttttatttctaatgtagatgccttttatttctttgtcttgcctaattgctctggctagaactgccagtgctacgttgaatacaagtggcaaatgcaccatccttgtcttgttctagatgttaggaaaacagctttcagtgtttcatcattgatcatgatattaactgttgggtttttgtacatcccattgtcatgttgcagaagatcccttctatgcctagtttattgagtatttttattatagcagggcgttatatttcatcaatgttttttctgcatcaattgaaataataacatgcttattcatttcagtgttacagtatattacactgattgattttttatatgttgagccacccttgcattttggggataaatctcaaagggtgatagtttacaatcctttgattatgcagtattgctgctagtattttgctagtattgctagtattgtgctgagatttttgcttatatattcataagggatattgttctgtagttctctcttttgtgctctctttgtctttggtataaggataatgctgttatcaaaaaatgaattagcaagtattccttcttcatatattttgtcagaagagtttgagaagaaatggtattaattcttctttaaatgttaggttgactcagcagttaatgcagccatttggtcataaatgtttctttgttaatcgcttttgattactaattcaatctcctaggttatagatctattcagattttctctttcttcttgagccactttggtagtttgtgtctttctagtgattcatccatttcatccagggcacctaatttgttgttagacagttgttcatagtatactcctgtaatccttttgtagttctgtaaagttggttgtaatggctctgctttcatttattattttaataattagtcttccatcttttgctcagtcaatatagtgaaaggcttgatctttcaaagaatcttttttgggtccaacaaatgtataccttctgtgtattgatttatgtattcccctgtaatttctccctctctaaaatggaaaatcaactgtaattcagctgctttgcatgcagtttctcaggactccttaaacctgtgattcactgggccacagtcattcatataagctcaaaataagcctttttaaaatccctcaaagagtttggtttttcttctaaaattttgtaatgtaaattatatgtaaatcatggtagttggcatttttccacgcatcagtaagttgtctcacagtgaccaaatgcaacttgcagaaaacaattggatattatcttcaaaataatagcaatttcacttcagatgttctttatccaacatagatttaatacctaagagataacctataacataaagattcattaattatgtcatcgtctccaccattatccatgatgatcacatactttggaacttattctatggagaatagcctaaagtgaattcataataatgatacattgttatgcattatctatcttcttcttcttcttttttttttttttttttgagacacagtcttgctcttgttgcccaggctggagtgcaatggtgtgatctcagttcactgcaacctctgcctctggtgttcaagtgattctcctgcctcagcctttcaagtagctgggattgcaggtgcacaccaccatacctggctaatttttatatttttagtagagacgtggttttgccatgttggccaggctggtctcaaatgcattatgtgtcttctgagagtggtcaggggattcactctagcttaattgtcacttcttacagggagtgctgaggtttgtattaagattttacattttgaatgtatttattaggacctgattacactctcttacgctctgaccaaacaatatgaattctataatttttaattctatatcacttctccaggtacatatcatattttccaagacccatgattattttcatggtggagctacaagattcagcaaatagtcatatagaatatacttaagttcaagattctgaaaaaaataatacttttctattatgatatctgcatacttgcatgcaatatgtatatgcaatactttataaatacactaacttttatctattatttatctgaagttcaaatttaactgtgtcttttgttatctctcaactccaatgcatgggaaccttggtgttcttctgtccaagcttagctccaactacctccggagacccattggagaaagacaccagtttttgagccaactactacaattcttataatgtagataccattgtgtcttaaagtcagtttttttcttattattcttgtgtccaaaatgacagtaaaacacaaacaatatgactgtgctgatacgtgttggtggcacctattaattttttggttctggcactgaagataaatatgtgtatttatgagattaatcttttagctcgagaataacaaccacttaataaaatatacaattttgcttttataaactcaaatttagattaaattttttttcaagatgatggattagagactttaagcatgcttcagccacatggacatagcacaatagtgcataaatgtcaactctctgagctttaatttaagaagaagaaaaggaatccaccagaatcttgaaggacacaccagattccgggaaggagaatggaggcaaactgcccccatgatggcatccagctaataaaagtgagtgaagtaccagtaagtgaaatgtattttaaatatattctaaatatatatgcaatatatgtctattctaaatatatatgcagccaacattggaacacacagattggaacacaccccaatgacagtgttagacagatcattgaggcagaaaactaataaagaaattctttgggaggccgaggcgggcggatcacgaggtcaggagatcgagaccatcctggctaacacggtgaaaccccgtctcactaaaaatacaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaagaaattctgcatttaaattcaatgcttgaccatttggaattacaatacacttcattcatcaaccacagaacatacactgtagtatcatctgcgtgcagatgagtatactgctcaaagcgatttacagattcaatgcttttcctatcaaactactaatgtcattttgcacaaaatagaaaacatctaaaatttatatggaacctaaaaggagtctgaatagccaagccaaagcaatactaaggctagagacataggctagagacatcatattacatgacttcaaactatcctagaagactatagtaatcaaaacaacatggtactggtagaaaaacagacacatagaccaatggaacagactagagtactagaaactaaggccacatgcctgcaaccatcacatctttaacaaagttgacaaaagtaagcaatgggaaaaagacttttatttaataaataatgcagggataactggctagtcatatgcagaagaataaaactagacccccatatttcaccaaatacaaaaattaacttaagatggattaaagagttaaatgtaaaatctcaagctataagacgcctagaaaaatcctaggaaatacttttcttgtttttttattttattttattattattatactttaagttttagagtacatgtgcacaatgtgcaggttagttacatatgtatatacgtgccatgctggtgtgctgcacccattaactcatcatttagcattaggtatatctcctaaagctatccctctcccctcccctgaccccataacagtccccagagtgtgatgttccccttcctgtgtccatgtgttctcattgttcaattcccacctatgagtgagaatatgtggtgtttggttttttgttcttgcgatagtttactgagaatgatgatttccaatttcatccacgtccctacaaaggacatgaactcatcattttttatggctgcatagtattccatggtgtatatgtgccacattttcttaatccagtctatcattgttggatatttgggttggttccacgtctttgctattgtggatagtgctgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccatatggcaaataatttatggctaagtcctcaaaagcaattgcaactaaaacaaaaattgacaagtggtagttaattaaactgagaaacttttgcacaacaagagaaactatcaaggtagtaaagagataacccacagtatgaaagaaaatattcacaaactacgcatctaacagaggtctattattcagaacctataaggaactcaaacaaatcaacaagcagcagcaagtaactccattaaaaagtgggcaacaggacatgaacagacacttctcaaaagaagacatacacacaagcacccaacaaacatatgtaaaagtgctcatcatcattatttattagagaaatgcaaatcaaaaccgaaatgaaataccatttcacaccagtcagaatggctttttttgaaaagtcaaaagaaaaacacatattggtgaagatttagagaatagagaacacttacacactttctgaaggaatgtaaattagttcagccactgtggaaagcagattggggatttcttaaagaactgagagttgaactaccattcaacccagtaaccccattactgggtatatacctgaaagaaaataaatatcctaccaaaaagacacatgtagccatatttttagcacagcagtattcacaatcacaaagacatagacttaacccaggcgtccatcagttgtggtctggataaagactcatggaatactatacagccagaaaaaactcaaaattatgccatttgaagcaacatggatgcattgtttccagcaaactaatgcaaaagcaataaacaaaataccgcatgttctctttcataagtgggagctaaaagctgggtacacatggtcataatacagaggggtgggaggggctgggactggtggctcacgcctataatcccaacactttgagaggccaaggtgagcggatcacccgaggtcaggagtttgagaccagcctggccaacacggtgaaaccccgcctctaatgaaaacacaaaaattaactgggcatggtggctggcgcctgtaatcccagctactccggggtctgaggcggagagtcgcttgaacccggggggcggaggttgtagtgagccaagatcgcgccacatcactccagcctgggcgacagagcaaaactctgtctcaaaaacaaacaaacaaacaaacaaaaaacaaagagggaggggggagggaatacatattgattaaaactaccgattggttagtgtcctctctaccttggtaataaattcattcatttaattcataattcattcattcaattcataattcagttccccctgagaaaaaaatattcacttgtcattaaaatctctctgtatcttactgatttcagatagaagttaaatttcaccttaataatagaaataaaagaactagttaaactgacaaaaactaataaacgtttgctcaaatttactgagagagtcatgggtacttcatataatagtaacattctaccagttttaagtaaaataaataaggaaacaatcttaactccatcgcctaccggaagggacgtgcccccgctcccaggtgagtgggaccctgctctctgggcggtttgcgccgcggtctctggcacctcttgttggcagcgtcgccgttgcaggcacagggcaggcattggggggcgggcagcgggccaggcccaggtgactcctttgccaggggctgggcaggaggggagaggggcggagcggtgctgccctgggcgagggagcctcccgctctggatggttcgctgcccctgccccaggaaggcactgcaggatctgggtggggaaggggagggacgagggaacacaggccagggcaggttgccccttagacctgggtgatgcaggaggggctgtgggagaccagagaggacccgaagcagaaaccgggaactgatacctctggctgaatatttgtcctcttgctgaagtttgaaagtcagttatttcattaaagtttaattttattataaaaataacaactattaaaaattccctgtagtcactggaatgataaattttggtgcagtttcagcataacactctaattattcaaattgtggccatgtttcaaaatatatgccataccaccctgtgtccctgtgtcccgcatccgcctctgtgtccctgctggctcaggaaacgagcttcttcctccttccacagactcgaatcaggccgtcctccctcctgcgcctgaggctgtcacggggacagcctgccttcgaatagccggagaacgcccggcctgtgccctgtgctcggcctggtgtcctggctcgtgcccctcagagccccgcacaaagcagtgtgacaggtgtggaaggacccagcaccaggcagcggtgagcggatggatgctccagggatgtggggctgctggcagtcaagaacccattgccaaattccatggcataattttggatatttttcccttatatttttgtgtaaggctttcagacttacacattttgagttttaaaaaaaaatagtataaactacaattctgacttctgtattttacatgttgatagcaagtcttcataccgttttttgttaaagggggctattccctctccatagtttggcctttgcacccttgttgaagatcattttgaccatatatacaaggttttgtggagagaggggtctctattattttctatgtctacacgtcttgatttaatacatttctttttagattttctcctttttactttttgagacaggttctctgtcatctaggctggggtgcactggtgcgaccatggctcactgcagccttgctctcccaggcttaaaaaatcctctcacttcagcctctggaatagctgagactacaggttcacgtcacattgccaggttaattttaattttaattttttttttagcgatggatgttctcactaggatgtccagtgtggtttgaactcctgggttcaagcaatcctcctacctcagcctcacaaagtgctgaggttacacatgtaagccatagaacctggcctcaaaataccacatttgaaaagagttcaacagcactgcaattagtttttgatttaaaaattgtgagggctccacaattgacattattttacaagtttaattggctattttcaatcttgagatttcatatgttttagaattttgtatttctgcaagtaaatattgttatgatttatatagctattgcatttaatctgttgttgatttcattagtatagacttaagaatattgttttctaatttatgaatatgggatatcttttcaattgtctaatctataaatatagaatatcttccccattgtttgtgacttttcttcagcaacatcttgtaacttctagtatactagtcttacatctctttgcttgtttattccaaagtatattcttcttaatgctattttcaatggaattttaaaaacttggattgtaccgtgtaatgaagagaaatacacttaattttgtattctgcaattttgctaaatgcaactattagttctaacaggtattgttttcagcgtataggatttttttgtatataacatcatatcataagtaacaggtacttttacttcttcctttagaatgtggatcttttctttttttcattgcctagttgttttgccaggactttcactgctatttttgaatagatgtggcaacagtgaatatcttgccttattattaatcttagaggataaactttccacagttcagaattcagtataatattagtgatgattgttttcgtttttttgtttttgttgttgttttcgcttttctgagataggatcttgctctgtcaaccaggctggagtgcagtggcatgatctgggctcactgcaacctccacctcccgagttcaagctattctcctgcctcagcatccctggtagctgggactacaggcacacaccacaacgtcaagctaatgttaatattttttgtagagacagggattcaccatgttggtcaggctggtctggaactcctgacctaaaatcatccacccacctcagctacccaaactgctgggactataggcatgagctgttgaacccagttggtgatgagttatttacatatcttttgctatgttagtttccttttatttctagtttattgagtgttttttttatcttgaaaagatgattaatactgtcagttgacttttctgcattatttgagatgattgtgtggtttatatcttttactctgttaatatgatatattaaattgattgatttaaactctcattccaatatagccaaataggaagagctctggtctgcagctcccagtgtgatcaatgcaagatgggtgatttctgcatttccaactgagctacctgattcatctcattgggactgattggacagtgagttcatcccacggagggtgagctgaagcagggcagggcatcaactcacccaggaagtgcaaggggttgggggattttcctttcctagccaaaggaaggcatgacagactgtacctggaaaaacaggacactcttgcccaaatggacataaatgacctgatggagctgaaaaaacacagctcgagaacttcatgaagcatacacaagtctcaatagccaaagtgaccaagcggaagaaaggatatcagagtttgaagaccaccttgctgaaataaagcatgcagacaagattagagaaaaaagaatgaaaaagaatgaacaaagcctccaagaaatatgggactatgtaaaaagaccgaacctactattgattggagtacctgaaggagatcgagcaaatggaaatgagctggaaaacactcttcaggctgggactacacagccaaggttttatatacaggagaacttccccaacctagcaagacaggccaacatgcaaattcaggaaatacagagaacaccactaagatactcctcgagaagatcacccccaagacacataatcatcagattctccaaggtcaaaataaagaaaaaaatattaagggcagccagagagaaaggtcaggttacctacaatagtttcatcagactaacagcagatctctctgcagaaaccctacaagccagaagagagtgggggccaatattcaacatttttaaagaacataatttttaacccagaatttcatatccagccaaactaaccttcataagcaaaggagaaataaaatcctttccagacaagcaaatgctgagggatttcgtcatcactaggcctgccttacaagagctcctgaaggaagcactaaatatggaaagtcaaaaccagtaccagccactgcaaaaacacaccaaaatacagaaaccaatgacactatgaagaaattgcatcaattagcatgcaaaataaccagatagcatcatgatgacaggatctaatccacacataacaatactaaccttaaatgtaaatggactaaatgccccaattgaaagacacagcctggcaaattggatagagtcaagacccagtggtgtgctgtatttgggagatgcagctcacatgcaaagacacacataggctcaaaataaagggatggaggaaaatttaccaagcaaatggaaagaaaaaaaaaaggcatgggctgctatcctagtctctgacaaaacagacttcaaaccaacaaagatccaaaaagacaaagaagggcattacataatggtaaggggatcaattcaacaagaagagctaactatcttaaatatatatgcatccaatacaggagtacccagattcataagacaagtttttagagacctacaaagagacttagactcccacacaataatagtgggagactttaacacccaactgtcaacgttagatgaacgagacagaaaattaacaaggatattcgggacttgaacacagttctggatcaagcagacctaatagacatctacagaactcttcaccccaaatcaacagaatatacattcttttcagtgtcacatggcacttattctaaaattgaccacataattggaagtaaaacactcctcagcaaatgcaaaagaacaaatcataacaaacagtctctcagatcacagtgcaatcgaattagaacccagaattaagaagctccctcaaaaccacacaactacatggaaaatgaacagcctgctcctgaatgactcctgggtaaataatgaaattaaggcagaaatcaagaagttctgtggccaaaaacatatgaaaaaagctcaatgtcactcatcattaaagaaatgcaaatcaaaaccacaatgagatgccatctcacaccagtcagaatggcgattattaaaaagtcaagaaacaatagatgctggtgaggttgtggagaaattggaatgcttttgtactatacgtgggagtgaaaattagttcaaccattgtggaaggcagtgtggcaattcctcaaggatctagaaccagaaataccatttgacccagcaaccccattactgggtatatacccaaaggattatatatcattctagtataaagacacatgcacacatatgcttattgcagcactatttacaacagcaaagacttagaaccaacccaaatgcccatcaatgatagattggataatgcaagtgtggtacatatgcaccatggaatactatgcagccatgaaaaggaatgaaatcatgtcctttgcacagacatggatgaagctggaagccatcatcctcagcaaactaacacaggaacagaaaaccaaacatcgtatgttctcactcataagtggaagttgaacaatgcgaacacatggacacagggaggggaacaaaacactggggtctgtctggggtcgggggagaggtgagggagagcatcaggacaaatacctaacgcacgcagggcttaaaacctagatgatgggttgataggtgcagcaaaccaccatggcacatgtatacttaggtaacaaacctgcacattctgctcatgtatcccagaacttaaagtaaaattaaaaaacagccacaaaaaagaaagtcaagctcctgagtggaagaaggaaagcacttacatcctcaatacatatctggatggtggagtcaaacttgggactttcctttactcccaccacctccaactgctgccagtgttactgtgtatcaggaagtaaacttcacaggcagcctctgaggcaggaactctcactagctgttctccaggtaaggaaactggtgcccaatttgttaagtaccttccttgaagacacctggctcgtatgtgagggagttgagacttgaacctaggcagtctgcaggacggagcacagagctgagtatcaaaggataaatggatggggttggtgtgaggggagaatagggtctattgaaaaggagccacgatttcttcctcagtagctggcactggttgttctagcaacaccagccattctccccacccacacccctgctgaaaggctgagtttcacttccagtccctatgggtgaatccagggagtcatatgtgaatctggtagtctcacccccactcacagttgactggattaaagtcgagtatttaacacaaagggagtgaatcagaactctctcctaggactgtggactaaagacattaagtaaaggattcagttgctgtgaggccacgttgcaaggtcagtgtcaaggctggaatcagcacttggggttttggtagagaagcatcctcagctaaagcttttactttttcttaaattcatccttatcagacttttaagatagatgctcagggatcccagggtcagatgaaagtaggagaaatctattgctgctatgccaggatcaccaggtgagccttgagaagcgctggaattcatagagtcatagctcagcaaaggaaaagaggagtccacagagtccagccagtgatgcccgtatagctgagaagggtacagaaaggtgagggcagtgtccagatgactgtccctcaccatcctggtcagccccctaggtgtacaggtgcacaggtaggaagtcctgagcttactctgtgtgggaaagccaaggttttgttttctgtttttttttgtttgtttgtttggaagcggggtctcactctgtcacctagactggaatgcagtggtgtgatcttggcttactaaaacctccacctcccaggctcaggtgatcctcccacctagcctcccaattagctgggactacacaggcacatgctgccacacctggctaatttttgtattttttgttgagatggggttttgccatgttgcccaggctagtcttgaactcctgagctcaagcagtccacccacctcggcctcccaaagtactgggattacagggttgagccattgtaccaggcctgggagccaaggttctacatacagatttttaacacagaattcttaaagctaacaaaatatcaccaacaccttattaggggaaagcagaatgttcccttataagtaatttactattatgaagtggtttggtgagggtggggggttcaaggtgacctggccagaaaattgggctttttctagctttacacatggcaaggcagagctacaggggagtcaaagttagtgagaagcaaaaccttaagagtgtttcagggggggtccttttccagattggacaacagcgaactggcctttctttcctgatagtcacagacctcagccctgcttacagagtctgtgcacaaattatctttgtgctctatagtttaccttttgacttaaagagtcaattttcacctcactttcacgctaaaacttcaccccaaactgaacatggaatgtacgtttcatatatgtttactcactacacacactcctgacttcccttatgaatattcatagatttcctccaaacctgatgaatatgtatgtaaggctaaccttgcaaggcatgaatataccagctttcctttcccttccatggagcacatactttgttttccttggaggtggcattccccaatatgcagattatttctccctctgaaaataaagttttctcctttccttcctccatgaggcttttttgtttacaatcctcatcctctgccatatgtcttctgctgggttctcctaaagtagacctggagttcgagactcatgtgtaaattgtctgttaaggaagtgttccctggagggcatggagaggaggaagaaacgagacagggctgtgatatttatttattttattatactttaagttctagggtacatgtgcacaacgtgcaggtttgttacatatgtatacacatgccatgttggtgtgctgcacccattaagtcgtcatttacattaggtatatctcctaatgttatccctcccccctcccccaaccctatgacaggcccaggggtgcgatgttccccttcctgtttccaagtgttctcattgttcaattcccacctatgagtgagaacatgcggtgtttggttttttgtccttgagatagttggctgagaatgatggtttccagcttcatccatgtccctacaaaggagtgaagtccgctcctcagcttgatgccatggggcgctctggagtgggaattaccccacagtttatcccatctcaagacaaaggagtgggactttcacactcccacacccttagtagttagtgcacgggcaatcactgaagaagggaacacgtgctggccattaggagccaagcatggagaagctgtgagacactgctgaagggattttgtaggcacgtaggtggaggtcaaccagaagacaagtgagccgggatcagagctacccagccaacctgcagctgtgtgagaagggaaggctttttggcctgtaccagtgagatttttttgttgtttgtcatgcagcattattgcagcagtagctaacggtaagttattgtgattttttggctccttatggttttccagtgctttgaaatgcagctggacattctgctgctgggttctgtggcatacaaaggatcctaattttaaaaagcaaaacaaacatttcgacttcagctagtttaagccgtttctctttccttgcaaggaaaagatttcccacctatcagctatgcagctgcggtcgttcaggttaagatatgatttaacatactctgtggcttcttcttggcttagaatatttctagacagtttttgaaagaatatcccttgagcttaaccagcccaaggtacactcaactcctttgagtcttcatccaggatgtcagctttacctgtgggtcctggcaattaagtaaccttttatgagagtcctgtaggggcccggaggagctgggctctgtgtattgatgaaaggaacccagtgcttcctctcctcagaagcttgaatggcagaagtgttcgcagccttgagctaaagcagggataaatcattcactgtgggttttttttattataaaagcccagatgggcttcctggtagaaggtggcggaaacagagctgtctgcctccaaagggcacctctctatgtcttcattcccaaagtaggtgcataattagaaatcctgcaattcttctttaaaacgtctctaaggttttccttaagattgtcattagtgccttaaattgtagcataacttgattttcgtgattgctgacacctcatactatcagaatcaaggtataatttcccctgaagtattaatgagaagaaaagataaggccactttgacttcctcgaagcatccctattctttttctctggcgtgttgctgttcttttcattttaatttttaagaaacatccaggctttttgctgtaattgcaaagcagggaattgagttggttttggactttattagtctgcttatgggttacaaatgttttggacaattgtttaaattgtaaattcatgatcttatttctttttcctctctgtttaatttccttttctctttcttccttggttatgaaaatgggagagttctctgaacccccttgcaggatgtgtggcttatctgttcagccttcatgtgcactcaaacccccttaagggagggagtgcatgcagatgggcaggtgcaggagcctgggcgagtgcccctgggctctggccccacagcagcatccaggggtgggtacctaaggctcctgaagcccaagtgggcatgtgttacagtgtgctctcttagctttgccgtccatggacagtgttaaccagcttagtaccctcttggtacccgggtcctggtccagaatccaggaagaatcaggtcacacacagacttgaaggatgaatgcaggggttttattgagaggtggaagtggctctcagcaggatggatggggtgctggaagggagatggagtggaaagatgatcttcctctggagtttggatgtccagaggccgatctcctctccgactgtccccagtcgaactcctgtcagtgttcagatactccttctcttctgtctgctgcacggttctgccatccatctgtttttctgttcatctcctcgtctgctcatctgtccatagagcctgaggtttgagggcttatgtgggtacagggtaaggggtgtggcaggccaaaaggcaacttttgggtgcaaaaataggaatgcctgttctcaattcgggctgtgggtttccaagtttgagggtgggatctttgccagagaacgtccctcttctacactgtatttccctgtcttctgtccatgtcagttagagtgtaagacatttggtcagcaaaattaactagatcatgagtttgagaggtagctcaaccaaggtattgtctctttattataattgccagtttttcatctagtccatttataaattttgagttaaggagaatataattttggtgattagaataactttcttctgatgggcctgaatattgttgaaatactttttcaaatctctcatagtatgatattataggctcatcaaaattttgttggcattgctgtattttactccaatcaactactgttttgaaaactaagggaatagtatctagtaaagacttggcagtactgcaggcccattcatgatctgcttcagaaaatttatgcaagtttttcacaatattcctgcagtttacctttgctacccagtcttggcttttctttctgatattaacatgtgaaccaattggtatatgtcagaaaatccagccagagtcataagttcaaatatttagttcaaattctttagcaaattcaatcgagttctgaagaggatacaggaattctttacatctttaagttccacttttgaccataatcaataaccaaggcagattctcctctatcagacacagagtattcccagaatggagccagaacagcagaaggtagaggaggaaagagaagtaagtttggacaaggaagttctggcaaaagaaaagaagatgaagaagggggaaaattttgggcagtcattttcaaatcagaaagtgttttagacaatcttttgttttccacttgcaaagaaatgactattagaacctgtctagaaacttctaagtaccattgaaaataggtaccatccccagttattttattttagggcttgctttttgtaattgactgtactgataaactaggctaggtatttcaaaggtactccatgtggaccattgtaatttggggtctctgggagttatgtgagaccatttttctaaatatttgcatgaagaaatgctgtaagtattacacataagtccagttagtgtttctaaaggtgattctctctgtaaggaggaagactcagttttagaagtataattgcccacaatttagatcttcctttcgcaagagcaaaaatatctaatgggattttgttttggatcaagtgtgcagcttataggaatagctcctcaaggtgtcagccttgagtgggttcttcccttttacatgtcttggtggttccaagaaacttggtgcttaaggcattagatgaccagcctttatgtgtgtccgctgggttaagcaatgctccctgcatgttcttcttaaaagacttccgtgagactgttcacactgtaagtgattagctccaacattcccacaagaccttagccacctaaggtgccttttggttaggaggaacagtgtcttattttgtcctcttcttattttggtcactcaagaagaaagtgtagatttatcagttgagccaagcttcagaatctggccagcttttaaaattacactttttatttatttttatatttttgcttaagccacaaagatccacttcctctttccagagagaaactgtttccccactgactaaaattctgaatgagagaaaaggttgaaaatcaaaatctctaatgaataattccaaaacaaccccttaatctcagagaaaagtaaaactcacaaattcatgattagcagaatctctagagagtaacaaatgaaactcctagcttgaggtagagcttcaattccaactccgttgagttaggaatgtgtgtagctcaaatagtctgaatccgcaagcgagcctgggatgatttggaccaagaggggccttaccagagatctccattgactcttgtgaaactgggtgaatgaaaatcctttgcgttggtgctgttaccagaaaggggtcctgatccagaccccaagagagggttcttacatctcatgcaagaaagaattcggggtgaatccacagagtaaagtgaaagcaagtttattagagaagtaaagaaacaaaagaatggctactccatagacagagcagccctgagggctgctggttggctatttttatggttatttcttgattatatgctaaacaaagggtggattattcatgagttttccaggcaaagaacctggagttcctggaactgagggttcttccccttcttagaccgtaaagggtaacttgcagacatggccatggcatttgtaaactgtctgtggcactggtgggagttctttagcatgctaatgtattatgattattgtataatgagcagtgaggctgaccagaggtcactttagtcaccatcttggttttgacaggttttggttggcttctttactgcatcctgttttatcagcaaggtcttcgtgacctgtattttgtgccaacctcctatttcatcctgtgactaagaatccctaacctcctgggaatgcagcctagcacgtctcagcctcgttttaccccactcctattcctggtagagttgctctagtttgaatgcctctgatagtaccagtgccccatctgtcggtgaagtgacagggatcactgaaggtccacaagagaatttctcagctgcagcacctgattaaagccttcttccctggcaacattcatctcagtgactggcattctgtgtggcaagcaacaggatctagaccacactcttagtgttttggtgacaagagttcatcacgctactcagaactgcatgtaatttaaaatgtatgcattgttcattcctggaatttttcatttactgttttctgactatgattgactgtgggtaactgaaaccatagaaagagaaaccacagataaaggcagactaccatagtcagaggttgtcagaatgttaatcttaaataatgagattcagaaaagatgattaagtatagagtttatttgagcacaaagcttgggaatggccacccacaaaagcactgactccagacaaatagggtcagcatttgataagtggggaagctaaagtttcaattatataggcaaagacagagaaattctagcaggattacaacattttccatataagatcaggtatacatgccatagcaatttgattgtttacagattgccacattccaatagagattactttattactctttgaggaggggcagtaatctgagggtgtcttatttccagcactgcttggtctttttaattatttacagaaacaaaaggaagaatttgcagctggatgtcatgtgactcaggttttataggcacattcaagactcagtataatttaaagtcccaacagctttaagtttgaactatttaatttcacagcctaaaatatttcctgtcttagaaataaacatttcataagttttaaattgcatgctgttctgaaatcttgttacaaaacaccagagatttgttctaggtcctgttgctcaccacacagaaaaccagccactgaaatgagtgtcgtcaggaaagaaggctttaatcgggtgctgcagccaagaagagtgggaatgagtctcacatccatctctctgatgactaaaattgggaggtttgtatagtggagaaggagggaaaacaggaattagggaggagtaaggaagcagttatgatggattaagggtctgatgactcactgcctagatgcagtgatctgatgagtttcagttcatctcctgaggaaggaactcagatgagacaaatgtaagtttgaagtgttaagaccaaggagaatcagcttctatgtttattcaaaaaactgtaaatattagttccatgagacaattgaggcagtttcaatcttcactttctatgtatcaattcctcagtcatggggaatctgctggtcatttcttttggctgcttcctgcggaagagggggcattgtgggatgatcatgaggaatgaaaacattacccctgtaaatggaagtactcatgagtacctggctggcatccagcttgttgaaacaccatgtgactccaattgtgtcttgttataataaaagaaaacagattcttactgaaattagggaaatagctatattgccacagattaagaatattcagaaatagtttctgaattctggagaattcaagtagagatagagaaatatgcatcaggttttgtttacaaggctaaaatagcttaaaaaaagaatttttcttgactctgaaaaacaaaacaaaaagaattagcaatgtttgaaagaaaaaagccacaaaaattatttcagttctctaatagttcagtgcatgcaattgactcttgtatttgcttcatattgggttaacaatcttcatgaacaaaaacagctctgtaattttagtcctggccatttctttttttagtccaatggcataatcaccaaagttatcagaaatctatattcaagagtctttttcatggaatctcctaaagaagtaagttgttttttaaaaaaacaaaaacaggccgggtgcagtggctcacgtctgtaatcccagcactttgggaggccgaggcgggtggatcacctgaggtcaggatttcgagaccagcctggccaacatggtgaaaccccgtctccactaaaaatacaaaaattagctgagcatggtggcaggcatctgttaacccagctacctgggaggctgaggcaggagagagaatcacttgaacccggggggtagaggttgcagtgagctgagattgtgccactgcaatccagcctgggcaacagagcgagactccatctcaaaacaaaatcaaaaacaaaaaaccaagacatttattctctcatggtttttgaggctagaagtccagaatcaaagcattagctgagctggtcctttttgcaggttctgatagagaattctgtgcctttcacaccactttcagtggttgctggcaatgcttggcgtggctcggcttgtagctgtatcactgcaatttcctccctcagctgcccatggcattccactctctgcatctctgcatgtccttcttcttctcataaggggtcagttatcagatttagggcccacctaaaatgatcctatttccaaataaggtcacatcttgacgttttggatggacacaaattttggagggacactattcaacccattacaatagtcatccaggaactatcaatgaccctactataattaaactaccaatgtttacacattcttcttttgtccgtagagatacagtgactatagcaaattctttggtaatttcctaatccagaaatggtgtggatattcagaaatctagatcagctttactctgtatatgtgtaagaaaatttctaagactaagaagtaagttttggactgtagctgattataagctgctttttgagaagaatcaaaatgaagcaataattgtggatgacaaaagtcttaggacagccatagttaaaaacacagttgacaaagaaatttggttatttctgtgtcatacaacaatttaacatagtaatcattattactatcactgataacatatactaagacatataagaattttaggaatctcatacaactttggaacacattaataacatatttatataaatataacccaaagaaagttaaatacaacttcatatttgataatgttttctgtataattttgacatatcaaataagcttacatgtctctcttggactttgggggaacttaatatctcaaaagttagtttgaggtaaaaaaaaaaaaaactgaattagaacttgagatttttgctttgcaagtttgtcaaatatcaaagatctaaagcacttgatattcccaaataggatcacaggtcattcatctagccaaaatgacaattcaaagatttcaaaaaaatgataacatttattctttgatagagaggagactcagtttcccaaacaataaaacctaataaaggcagcatgaagccaactaaatctttctctttctttctttctcttttttctgcagtttactcaaaaggtagacaacaatcttttattatctcttattaatattacatgaaaattttgttcaaaagataaaaccaaattctaacatttgtatagtgtactattaatgttaaagctaattttaatggaaccttatgaatgtatctatttaattttaatcagtttgaccaaaagataatatttccataaatcctttataaccttttacaattttctactaaaatgtagatcagtgctccaagaaaacctcgttattctgacacagggtcccagatgctggccttgcattggtgtgcttttgatattaatgtttaatttgtagaaaaattctgaactaatcttatctctcaaaatcggcccttaaaatctcatgcactcacctcttccttgatagtccctaggcctggaaggattgaatagttttaatatatagctctgtgtctcatgaaagcaactcattttgattgttgccttctcccaggtctgaagacaaggctttgactggtgtcaatgtttaagatttagcaggagtcggtgcctttttcagacccaggagttaaaggcctgtaacttgacagccaaggactttaaaagcaatacagaaagttacacggatgtaaaaaccttaatttatttatattttaattttatttattttattgagacaggcttttgctctgttccccaggtcagagtgcagtggtgcaatcatggcctgctgtaagcctccacctcctgagctcaagcaatcctcccatctcagcctcccaaataactaggactacaggaaagtgccacacaccttgctatttttttttttttttttggtagagatgggacctccctacgttgcctaggctggtcttaaactcctgggctcaagtgatcctcccatctctgtttcccaaagtgttggggttacaggcatgagccaccatgcctggcccttcattccttttaattccagttttcttaagccatcaaaaacctaataacaatgacataggaattatctcaataaaacatagaatctgtttcttaggccagttaccaaaaagcaaagaaagatcatatgtagtatggttgtctctcctatggtatcttaactttttcatattcctctcccctgcttactgtttcctttcttctttattttataaatcaccttttcaagtccataatgtgaatcaacctttagataacttttgaatttagagaatttttttctcagtagggatacattttctttgtcacattttatatacagaattatatattaattagaattcttattctttagcaaccttacattttaatgaaaaacctaggaagcaagaaatattgaactatctatcagatatcagcatcttttagataagaacattccataatttttaaaaacatgtttccccattttataatcccttcttaattagaaattaccaagacatttaatgaccattcaaatgatttcaagattttaaattacacaaaaatttcacccacagtatttaccccatttatattttattcacttttagcaatttatctagattacttaggagaactgagatattagacaaaactagtcattatttctttgtcaactaatttttataacctgtgcatattaggtgttcacctaagtaagaagcttaaggttaaatacctgggtattttcatcaataactcagaagattcagctgttttcataaaaccaaaaacatgaaattagtcttatttatcaaaaaaatcactcaaagatcattttgtttttggttgggtttatagtcttataatcttttgtgccaaaccctgacatctttaaatatgtagcacaggcaaatataaaacctggaccaaaaatgtatgctgaatattccaaagacatttctatttttattttacccataatcttaaagccagcttgtttattaaatatttactaaagtcatgtgaacttgaaaaatgcttagacttattaacttatgggtgctcttttgtttacaagccaatttggtactctgtagacacaatatataataaatgtacattcacataaacacatctagacatatatgcacacacacacaaaaagatccaatagcttttaccttgaaactctagccatgagataaaaacataaatttatcagtttacaaacatgttcacatggctaaactttgtttacctcaatagataatccaatgagggctgtgaccaaaattttgggtaaagcaatggtagtttaattctaaaggacaaacctcccaaaactccaaagaacactgggggccaagcatactacagaagaatgtcacatactaactgtgcccgactagggttagaacagaagcataaaagcctgcatacatggagctccatcctattttcccattcaacagcaaaatgaatccatttgtaagacagtactacaattgaaagactcatggagtccaagcctccccaaactccaaagaatgttgggacaaatagcattacaaaagaatagtatttttctttgttcttttcgtttataactatatgcagaccaattttgaagaacacacccaagtcaactgcattctagaatcaaattccaatttcccatgactatatcaacacacagaaaaaaaataatcaaaaatacagtctaactgcagtagtgactaacaagccccaacagtatctgaactgtagttgaggtgcttcccttttatagttggttgggcttgttcaacctgcaaacagaaattccttcaaaattccccatatcaagaggaactgatcctgctctctgatatccacaaaagatgctcatttatctggttacacacacaattactaacaagcccccaggagtgtccagaccgaaatggtcagagtgcttccctttttcaattggttgggcttgttcaacctgcaaacaaaaattcctttaaaatttcccaaattgagaagagcagattccactgactgggcccacacaagacactcactgatgtggaggcagatgtcatatttcaaaggctgtcttcctaggcaatcaggaatacagttggggctggcaacagtgcgagcagagagagagacacaaaaatctacctctggctaaaaagagacagatggctagctgcttaggagggcttctgagactctcctgtccctcgacagccaagtcacgagcaatgcactcctgatcagggaaccaagatctgttagcaaaatgccaggggtttggtctaggtcctgcagctcactgcacagaaagccaatcgctgagacaacaagtattgccagggaagaaggctttaatcagatgctgcagctgaggagaacagaaaataagtctcaaatccatctctccaactgactaaaattgggggatttctcttcaaggaacccttattttacttaatagtggccccaaagcacaaaagtagtgatgttggcatactgttatgattgttctattttattattagttattatggttagtctcttactgtgcctaaattataaattaaacttcatcatagatatataatagtatatataaagagtttggttgtggtttcaggtatccactgggggccttagaatgtaccccccttggatactggaggactaaagtagatgttttctaaagtttctcacagatccaacattccaaagttcttcatttccagcaaattcagctcagagagttagagtcaaactttatttgaagactttagtaattcaatgtcaattggaagtgatttacaaaatggaacaaacactaactttgtaaaacatagaaaaaatatttttaaagcatagtacataacaaaatacctttcttggaggtattataaaaaattccctggaatggaaaatatattttgaggaaaatcttgaaaattgcaaagcatttttaaagagagttaaaccctgggctaaagttgtggcagacacccatgccccatcccaccatcctggccaggtgccacttccatgtgctgtcctctaggaataggggctggctgagttcaggaaagcagcattagggttgtaggagtgattcagtttttcactgctaagaggtgaaaaaaattttacttttaaaaagaaaatgtattatcagatctcaagtatgtttttttcccttaagaatgaaactttcactttgttgagtgtatttaattttatttattcattttccttcctgaaattttggactcctttattaggctgacaaagcccactgccattcatattcaacttacctgcataatggtctcatttgcaatttgtgggtacgctgaaggagcgttgctgggctgtccttctgactttcttctgctgtgaagaccatttgtgagtttccaggcaatgggcgggtgggagggaattctcccaactgtaaaacccaggctttcaaacacttgaatgccaacagttcaactcttttatcagagccttggcattattcctgaagctcctcacaataaacttctgtaccaaattaattaaagaaaagcctgataattccattccgaggcattccaatgaaagtaatttcagatacataatgcacaattagcttttccacttaacttccaaatgaaatgctcatggtatttagtaccatttgcattaatcagcacaaccatcaaatccttaggcagaagagagaaactgaaaatcttggggaagaagatcttcttgaagtgtggtggtcattagattatctgtgtgaagtgtggtggtcattaagctatctaaataaatggtagacaagtggctacagggctacctcctgcctttcataaagaaggagcaattttaggaaagaatatgatgggacctactgtagaagaaaaattattcactggacacttgttaaaacagtaagaaaaaaaaaaacagtaagaaagactttgttcaagactattataataccagtcaactctattgcaataggagagagagattgagctaaactcctaatacagcagacagcttgggacttagggccaatgggcagaatgagaggtcagtggatggaaaattactaagaggtgacaccaagggtaggaagattcttgctaaaaacaggcagagaactcagatatcaaggatgggggcggggaggaactgatcagatatcaagggtgggagatgacttagaaggattcttgctaacatggagctcaccaagggcacacagaaaaccaaggtgaggcctggtagagaaaagggctcaggggagtctaactaaagtttggttaaggagggccgtctttgtcactgatcttcagctattttgtgataaaatagtagaacgtgggctcatgaggaaatcacagggttaaacattaggcactgggcagaattcagtgaagatggttatctgtgggagaaagggaactaatgaagaccacagaggctttacctcctgggcaacccttcaaagtccagagtcattggtgtattacctgtgagttggtgtggccctgcctaagaacatgtacaatctcagcatcgcaacaaggctcctgtgggagccccgggtgagttattgctggtgttgcctgccagaagctgcacctccagttagttgctcatcacaaggggaggctggctgaggtgccattggctcccaccccagcagcaggcatagaaaaactcccaggtgaggtgagggcccatcctgacccaaggttttcctattgccaacattacacagcagtgctcctgcatggctggccccgtcctacctctttagtttccacaaatcttttacatccggtttctctatcatctatccaactactagttcttccttctgggatctggtgtgtccagtatgctgttgctggtcaagtcagtattgaattgataatacatttatgtagcctgaagcccataaactctaaaaatacaatatgttcacttgcacaagcccacaaaagatcttatgccctgttcctacaatctcttcatcaataaggtgcatgaagggcatgccaaaattaaatcctggcatggagagatgctacagaagacaggccatgtagagacaactggaagcaaagtgaatgtcacttttttttttttttttttttaaacagagtctccctctgtcgccaggctggagtacagtggcatgatctcggctcactgcaacctccacctcctgggttcaagtgattctcctgcctcagcctcccgagtagctgggactacaggcgcacaccaccatgcccagctaatttttttttttttttttttttttttttttgagacagagtctcgctctgtcgcccaggctggagtgcagtggcgggatgtcggctcactgcaagctccgcctcccgggttcacgccattctcctgcctcagcctcccaagtagctgggactacaggcgcccgccactacgcccggctaattttttgtatttttagtagagacggggtttcaccatgttggccagaatggtctcgatctcttgacctcgtgatccgcccgcctcggcctcacaaagtttaactaggttctcagtaacctgagactgagagctagttgtgagatcggtgactctactgtcatgtgatggtgttgtgatgtattatccatatgttaaggatcatattaaacacacacatttacagtggacctactgtcagttcatatttaacttacctgcatcatggtctcatttacaattggtggacaccctgaagaaggcttgcagctgaagtagctgccaggcaggttttacttaattcttgtttattcacaaggaactgaggctctgacaggctgagaggtctgcctaaggttgtaggggaaaaaagtgacagggctggaagtcgagcctcaccgttgtgattccaagaccagactctttcctacatgtcgatagtcatctgtacacaccatcagtgctggtcagtgcgcctcactcacccactaaagactggccatctaacttccgaattcaagggtacctcccttatcttgcagccatctgttgcctgccgcagcagcagggaggaattaagagcagcagctgcagctccagcagctcaggggcagctctgggctccctaaatccaccagtggagacccacgtgcagttgtggggaaaagtttaactgccttgatcgttttccttccagtatgttctgcctttagcttgcctacctggtcctgtctgctggcttggcattgactttcagagagatatgctccagactacacaagtggttttaagctcctggctgtgttgatcactgttctttcccctgggcctccagtttttctgtgcctgtcctgcatctctgaaatcaagtgatatttattcatagctctctaaacctctggcttgggtttcttctggtaaagacgaactcttctttctgctgaggaactatgcaacactctggccttctctctacttcctctttcatccctaaacctttcaggaagtgaaagataggtcttgtttagaaaaaatgtggaagctgcttcagcacaggtctgtggccactctagtctgtttggcttcctctgttttctgcagccttgacttgatgccacttgtgcacccggcagcatgggcatcggcatctattgtgctggcaagggtggaggagaaacagctttgctgttagtcctggcctgagcattgctcatagtgccgactttaattaccaaacctttatcaatggatcccacaaaaggctttggttcattccattttgctttcccctaatttacttttgagaatgctggctgaaagctttagtcattcacaaagttggcttctgacctagaaatctctcactttctttggcctgagtgcttggcatctctactccctccagctaccacattcttcagctcctttggaaagatcagtattattcacagtggtaatcaaagaggcatcatttacagtcttatctcatctctcaacttctccatcatgattggaaaattgattccctactgaatcaatcaatatggcacagccatatttcttatgcaataatattaaactttccctattaacaattgattcatgtcccttgttgtgaatgtaacacaaagaaatgaagtatcctaataaatgaattggacctggctggctacagtgtagaaccacttgttggcgtcctcacaccagggcatgtgggaagaagtgcattggcacatctgtggccatacccattcctgagggaggtgaagagatggattgaggctggagatgcttgggaaaggtgttcataaaaaataccctcacttatcagcaaactcagagataaagaagaggcacaattcaaggctttcagatgtcaatttctttccaaactagagtaagaattcagcgtaagtaaatccatagggatagaaattggattagtggttgccagagagtggcaaaaggagagttgggattgactgctaataatttatttttggggtgatgagaatgtatgggaccagatacttgtgatggttacacaaccttgtaaatatgctaaaaaccactgcattgtacaccttagaaaatggtaaaaaaatgttttggccagcagggacctcacagctcctctggtcaggacatgtgccagactaaccaactgtcttcatttgtctgggactaaagaggttcctggggtctgagactgtcactgctgaaaccagtgacaaagcaggatgattcagtcaccctagtgtgtgctggggcactgttcaaggatgacagcgaaggcaggcaacctcccatttaacagggctatttctcattcacaatgctcttactaccaccttgtgaagtagctgccagggcaggttttacttaattcttgtttattcacaaggaactgaggctctaacaggctgagaggtctgcctaaggttgtaggggaaataagtgacagggctggaagtcgagcctcacccttgtgattccaagtccagactctttcctgcatgcgtatagtcatttttacacaccatcagtctggtcagtgtgcctcactcacccactaaaggccggtcatctaacttccaattcaagagtacctctttcatctttccttcccacccctagaagctgcctcctgtgaaacctctcctaacacagtgatccacccagcaccatctctaagttcatcttccttgtccctctgccatctctgtaggcagggactgtgtctcagtcatctctgctcttggttcctattaccttgcctggtgctcgataagccccagctgaaggaagcctggtgtctgttccaaagaacaaacaggaacagaggtctcagataagagaatatcctgttgtccatctctttgctattcctttcttaaggccgaatgagtctcttttcctgatgtgttcatatttcttaggtgtcattttctgaggagcttgcgggtggagctgtcacaatctgtctcttttcctgggttctgaagtgctgcttttcaaaatgtgttgtaaacatgctccaaaggccaagccaagccaatgggcaacaggcaatgagtggtacagctcatgcagtgaggcctgtggcctgggggaaaggatgtgccaggaggcaggcaggcttcctggcaggaaggcagttctggaaagtcttaatatcagggaagactgtcatcaatcttgaccataggttgcatgccagtatggggataggtgggtaaagcgagggtgctactgccagaagtaaggcagggttccagatccagagagatggagtgctggaatactctaggcacaaggtttcagaactgagttaaaggtaaaaagattggggcaacataggcaatgtgacgtcaaatccaagggtatggaattagaagacccagacgatggggctccaatgaccaagggatgctagttggggaggcaggtgggcagaaactgtgaccaagaagaacttggcacagatgatccatttaaatgagagggtggagctgtccttgcaaaccaatgatgcagctgatgccatgcagtggatcttccttccccctaaacagagagtataagtatgagtttgagaaatgtgctataagcacacagaaactcatgcacacacgcagggaggagatttgcctttaatttgttttgcttgcacctgttgactcatgggggtcaatggtatcctgtaaacataccagataccaaatgaaagttccctcagataacctcagataagacagccagttctcccatggcttattgttattattattagaattatatttatactgtcttttttgtctctatttttttatttttaaattttttatttccataggtttttggggaacaagtggtatttgattacatgagtaagttctttagtggtgatttgtgagattttggtgcacccatcaccatggtagtatacactgaacccaatttgtagtcttttatctctcaccccaccgaccctttcccccaagtccccaaagtccattgtatcattgttatgcctttgcatcctcatagtttagctcccacttatgagtgagaacacacaatgtttggttttccattcctaagttacttcatttagaataatagtctccaattccatctaggttgctgcaaatgccattaatttattcctttttatggcctagtagtattccattgtgtatgtgtgtgtgtgtgtgtacacatcataccacatttcctttattcacttgttgattaatgggcatttgggctgcttccatatttttgcatttacaaattgtgctgctataaacatgcatgtttgagaatctttttcgtataatgacttcttttcctctgggtagatacacagtagtgggattgctggatcaaatggtagttctacttttagttctttaaaaaaactccacactgttttccatagttgttatactagtttacattcccatcagcagtgtagaagtgttcccttttcaccacatctataccagcatgtactattttttttttatgccattcttgcaggaatgaggtggtatcgtattgtggttttgatttgcattttcctgattattagtgatgttgagcattttttcatgtttcttggccatttttatctcttcttttgaaaattgtctattcatatccttagcccactttttgatgggattatttgttttttcttgctaatttgtttgagttccttgtacattctagatagtagccctctgttgaatgtatagattgtagaatgtatagattgtgaatattttctctcgttctttgggttgtctatttaccctcccgactgttccttttacagcgcagaagctctttagtttaattaagtcccactgatttatctttttatctttgtttttgttgcatttgcttttgggttcttggtcatgaagtctttgcctaagccaatgtctagaagggtctttccaatgttatcttctagaatttttagtttcaggtcttagatttaagtccttgaaccatcttgagttgatttttgtgtcaggtgagagatgaggatccagtttcattctcctacatgtggctagccaattatcacagcaccatttgttgaatagggtgtcctttcccccacttcatgcttttgtttgctttgtcaaggatcagttggctgtaagtatttgggtttatttctgggttccctattctgttccattggtctatgtgcctattcttataccatgctgttttggtgactatggccttatagtatactttcaaatcaggtaatgtgatatctccagatttgttctttttggttagtcttgctttggctatgcaggctcttttttggttccatatgaatcttagttgttttttctacttctttgaagaatgctggtggcattttgatgggaatgcattaatttgtagattgcttttggcagtatggtcattttcacagtattggttctacccatccatgagcatggtatgtgtttccatttgtttgttttgtctgtgatttctttcagcagtgttttgttgttttccttgtagaggtctttcatctccttgtctcggtatactcctaagtattttattttattttattttattttttgcacctattggaaaagggattgagttcttgatttgattctcgggttggtctctgttggtatatagcagagctgctgattcatgtacattaattttgtatcctgaaactttactgaattcatttaccagttcttggagctttctggaggtgtcattagggttttctaggtatacaatcatatcatcagcaaacagcaacagtttgacttcctctttactgatttggatgccctttatttctttctcttgtctgatcactctggctaggacttccagtactatgttgaatagaagtggtgagtgtgggcatccttgtcttgttccagttctcagagggaatgctttcaactttttgccattcagtattatgttggctgtgggtttgtcatagatggcttgaagtatgttattacactgaagtatgtcccttctatgccgattttcctgagggctttaatcatgctcccatggcttactaagtgatgactgtctttagattaggttgtgggtttttgtttttttaaaacattttgactagttcaaaaagcactgggtggttattctaccccaatatgcacctattaagagagaaaggtgagaggaaaaaaaaaatgaaagtcccactctacatgatactgattgttacccatgttttatcctttctagtaaaccccttgatcacaaagttgttcaaaatgccctatttccagcctttggcaccaacctgcaattgcagtgttgcttttgaccttcatcctaacatccaccctcattagtgccatttttctctggtagagtcatgatttaacactcattacttccaacacaaagttctgctttgccaaatcagatcacaatacagaagtagcacatgcatactttcctctaatttaaaaggtgtataaggaaaactagtatttagccttaggcttgggactcctcagcacctgtgaaatgttggggctggtgtttacatttcctgagggtccaaaggtttcaggtaaggcagagccagcaaacttgtggcctgcaggctgcttccaagctattgaactgtcttgttggcagaacatgaaaaacttggaggccaggtgcagtggggctcatgcctgtaatcccagtactttgggaggccgagggaggcagatcacctgagggcaggagttcgagaccggcctgcccaacatggtgaaaccccatctctactaaaaaaattagctgagcgcagtgatgggtgcttgtaatcccagctactcgggaagctgaggcaggagaatcacttgaacctgggaggcggaggttgcagtgagccaagatcacgtcactgcactcaagcctaggcgacagagcaagactccatctcaaaaaaaagaaaagaaagacggagagttccagctccctctgaaacaattgtgagatttggctgcagtcagctggacttgagtgctggatgctccttttggacagatataggttctctgcagtccccacccctccctattgttttttgccagctacatcctttggtgatgctcacctgcctgggccctggaggcatgtcagtttgtaagttcatgaaattagcacttagctgaaactacttgactgtagcggacaaatcattccatcatcccccactcctcatttgaaatctcaaaacaagggtggaccataactctcttctccgagcctttctcacctctcttctagttcatctgtattccccagatcctttctcctgtgaccaataaatcccatctttaggctttggccttctgcttttctctctggaccttctccctgagatgcttcttgcattcctgtggtcccccaattgactgttggctgatgacccccacaaagctcttggtaccctcatctttcccctcaaggtctcatgctaggattaaactcagagagcaatggagacttgactttactgtggggcagctctgaatcaaatcctgggttggcagggtggctgtgggcacacatggaacatccctgggccttcacacctgtgtgatggttgtagcattacttatggtgattgaggatatttaaggtcatttgtagtgggtgcttggcaatggcagctgcttcctaagcccaaggtcactgggtgtcaaagccttgtagtttccacactattgtactgcctcaatcccagaagccttgtcttcaaacatgactttttacaatgagttgtcagtgttgtctcccttgcagtgcccaggacgaggcctgccagggagttggcaatggatggatgcacaggcaggccaccctgacaaacgggacaaggtagaatctgctgacaaggcagattgtcacggagttttttaggagtctggaagtgacaagaatggggcatgtgcctggtggcactctgcaatcctgtcacatcaaattggagctgttatttctatcattagcagcaaaggaagcaactcaactctctggagcttccttattaacaatcacaaccagcaactaaacaaaggcaggaaagcagagtgtcaatggtgatcggaggtttcctccacagcttccacaagcaccattttctccttaataatgggttacattttcaggagaggcttactttttgttttgttatactcttgtactttaaaagaaaaaaaaagaaaagaaaatgcagatatttcacagaactggggaaggttagggaggggaagggagaggaaaggaagtaagatttggtccacttctaacactgggcttggtgcattgcattaattatttcactttccatgatccagacttaactttttaagatcctaggctaggtttaagtgtagaaatatgaagtcatagaatgtaatacctggctgggtgtggtggctcacatctgtgatcccagcactttgagagactgaggcgggtggatcacttgaggtcaggagtcggacaccagcctggtcaacatggtaaaaccccatctctactaaaaacacaaacaaattagcgaggtgtggtggcacatgcctgtaatcccagctacccaggaggctgatgcaggagaatcacattaacccaggaggaggaggctacaattagctgagaatgcaccactgcattccagcctggggagacacagtgagacttcctctaaaaaaaaaaaaaaaagaatgcaatcctctttccattctacaactgagaaagaagtcacgtggtggctagtgataaaaagaacaggtggcagttctccttacccctcatgtctccatgtgtctgagatccagggacatttaaaatactgctgaaaggtcaggggacattggtgaaaacaactatgcaagcaaagaatgtttttcttcctgtgcagagaaagaaaatcccactttctctgtgtgtaagccatggtatgtgggctccctgagcccagtgaaatatgcagagatggtaaaactgtattaaaatctgattttctttttgttaaaaagatacccaggaagaaactatttcttttcttcttattattggatattgtcttttctaggctaggtacctggaagtgagacagctgtctctattaggagtgctaagctggcaccctgggatggcagaagaaaagagggaaggaactaaggtttcgaagatgaatattgggagtgacatgaaagagtcttggaagcgagacgcttccagccttctttttatgtgcaacattaagttttccttatttttttaaaggaagtgcagtcagcattttatattctgccaatgaagccatcccaaggagattctttgagattctgacacatcatctgttaaagggaaataaacagtggagagctggagccggctcataccagccaattgctagaatctcctcttaactcttcattcagtggcatcacataggaagctccagtgaagtcatgtggatgtggaaattcactgtggtgggaatatttagatgacaaaaatcagcaacgctacaaattggggcttttttaggagtcagtttaccagcacaccgctggaaaatcgtgcagaaccattgaaagcattagagatatgtctaaggcctctgttaatgggcttgctatagcaaatagaatttactgcattccccccttgctcctgagaacctcccccactgtaccaccatacctcctatagcttctgaatacccccattacaccccactgctcctgaacaatcccattgtactccccactgctccagagacccccattggatccctggctcctgatcaccttccactgtgtcccccctctgctcctgatcacatcccactgtgctcccctctgctcctgatcaccttccactgtgtcccacctctgccccaatcacctcccactgtgtcccacctcatgctcctgatcacctcccactgtacttccagctgctcctaaacaacccccagagtacttcccacttctcctgagcaccctccactgcaaccccatactattactgaacacccccactgccataaccaccactgttcctgaacacccccactgctcccgaacacctccactgtaccctgactactcctgaaaacacttcagtgtatctcctactcctcctgaacacccccactgtacttcccactgctcctgaacaccccactgtacttcccactgctcctgaacaccctactgtacttcccactgctcctgaacaccccactgtacttcccactgctcctgaacaaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacacccccactgtacttcccactgctcctgaacaaccccactgtacttcccactgctcctgaacacccccactgtacttcccactgctcctgaacaccccactgtacttcccactgctcctgaacacccccactgtacttcccactgctcctgaacaacccactgtacttcccactgctcctgaacaccccactgtacttcccactgctcctgaacacccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacaccccactgtacttcccactgctcctgaacacccctgctatatcccccactgttcctgaacaccccccatttctcttgaactcacccctccctcactgcttctgaacacggccactgtaccctgcactgctcttgaacactctccattgtaccctgactactcctaaaaacacctcactgtaccctttactgctcctgaacatcctcctactatttcccccactgctcctgagcacccccgctgtatactcactgctcctgagcaccccactggatcagtcactgttcctgaacacccccactgtaccccctactgtttctggtcaccccttcactgcacccccactgcttctgaacactccccactatatactcactgctcctcaacatttctactcttcccccgactgttcctgaaaacctctaactgtaccacctgctgcttctgaacacctcaactgtaccctctactgctcacgaacacccccacactatatcccccattgctcctgaacaccctcactgtacctctcagtgctccggaatatcccccactgtaaccactatccccaaatatccccccactgctcctgaacaccattcgccctacccccaactgcttctgaacaccccacactgtaatcaccattgttcctgaatattgcctcactactcctaaacaggcctactgtaccatccgctgctcttgaacacccctcactctatccccgactactcctgaacatcccctctgctcctgaacacctacccactatatcattaagtgctcctgaacaccccagtactcctgaacactccactgctcctgaacactccctctgtacccgtagtgctcctgaacacttcccactgtacccactagtgctcctgaacatcccccactactcctgaacagccccactatacctcctgctgctcctagacacccccactgtaccccctgctcctgaacaccccactgtactccttactgcccttgaacacactcactattcctgaacaccccccactgtacccctcactacttttttttttttttttttttggtgacagagtttcactctattgcccaggctggagtacagtggcatgatcttagctctccgcaacccccacttcccggattcaagtgattttcctgcctaagcctcctgagtagctgggattacaggtgcacgccaccacccctggctaaattttgtatttttagtagaggcaggatttcaccatattggttaggctgatctcgaactcctcaccctgtgatccacccacctcggcctcccaaagtgttgagattacaggcgtgagtcacacccctcattactcttgagtaccccccactatatgccccatctatatcactgttgaacatccccatctatatcactcatgtacttctgtacacccctcactgtaccactcattgcttctgaggcccctcccccatcataatctccccctggcagtcagtgcagttaccattgctatgcatggctgtcactgctaatcattgatatgtgcttttgtatatctgtcactcatttatggtttagagtccctgtagaagccttcagttggctaagctgaagtcatatgtgcacaccctcaatgccagaaggtaggaagagagaagatctgtgtgttgtgactagctgtgcctctcccaccaccaagactccatggtggagtccaggaactaggaaggagattcacatgctgcgtagaagagaaagaacctggtaaacactcagtgtttctgcataaagtgaatcatattattgctctttggatatatgttttctgttgggtgatgtttgaggtggtctcaggtcatttttctcatgtacctctgtggatagttagtgatggcccagtccaaaatgtacacatatttttctcaaagaggagagcaaagtctatatagtcgttccttggtatctgtgggagattggtttcaggacctccttcagacaccaagatctgaggatgctcaagtccctcatataaaatggtgtaatatttgtctctaacctaagcacatcattctgtatactttaaatcagtgatccccaatttttttgacaccagggactgggttcatgaaagacaatgtttccatgcaccggggtggggagatggttttgaaatgattcaagtgtattacatttacagtgcacttattttctattattattacattgtaatatataaggaaataattatacaactcatcctaaagtagaatcagtaggagctctgagcttgttttccagcaactagatgttctgttccatctgggggtgatgggagacagtgacagaccatcaggcattagattctcataaggagcacacaacctggatccctcacatgagcagttcacaatagagttcatgctcctatgagaatctaacgctgctgctgatctgacaggaggcagagctcaggcagtaatgtgggtgaaggggggcagctgtaaatgcagatgaagcttccctttcttgcttgcttgccctcggctcgccttctgctgtgcagcccagttcctaacaggccacagaccagtccctggctgtggccttggggctggggacccctgctttaaaccatttctagattacttctaatgactaaaacaatgtaaatgctatgtaaatagttcttatactgtatttttaaagtctgtatttttttattgttgtattgttagtttttcgtttttatttttttgagtatttttggtctgcttcattgaacccacagatgtggaacccatggatatggagggccggccacattcctttttattaaggtatattacagaatgtatacacaagtttccttggttccaagaaacagactgattctagccaactgagagaaaaaggacttatggctaggaaacacttgagctgctcctggatctggaaagctagtcaagaaacagggtggctttcgcaatggtttctgtctttcaggatggatttggtctttttctcgtggctcacatgggctctgtaacttggcatcactacttctctcctgctttggctgatttcctgctccggcaacctggcttggattttgatttggttcattactaatcgtttgttgggtagaaagcctcaaggatctttggctaggctaaggaatgagccttgtgcacacacagtttattcaatgaccacctacccatgcccaaagaatcacatagagctgttttcctgaacaccttgattagaaagggcttttgggtgtggcagacaccatgtctcatctgtgtctgctttgaggtcccctaattgtgacccaactcctctccctgtccttgggaagtcattgtcactttttggaaaataaagaaaccattatttagtaaggattatgcattgcatctgctattatgcattatataccttatctcaaagaatcctcacctcctctctctgaggtaggcattactcctagtttacatacgaggaaattgaggatcaccgaggttatgaccctgaggtaaggtggcggagctggatttcaaaatatatatatatatatatatatatattttttttttttttttttttttttttttttttggagacagagtcttgctttctcacgcaggctggagtgcagtggtatggtcttggctcactgcaacctctgcctcccaggttcaagcaattctcctgcctcagcctcccaaatagctgggaatacaggcacatgccaccgtgcctggctaatttttgtatttttaatagagatgaggtttcaccatattgaccaggctgatctggaactcctgacctcaagtgctttgcctgcctcaaagataataaataatttgtctggtctttgtcctgggttcttggcatggagcttctaaaacccatggagtttcctgggtgatagcagtgggtttgttatggtaatgaggtgactcctggtaggcccatacatagcttcaaggtaggggctggtcaccagaaagaccagccacaaggtaggattttgagccagcctgacctccaggaaggggcgtggtggctggagattcagttcaatcatgtgcctagtggtttaatcaatcatacctatacaaggaaaccttagtaaaaactagacaccaaactcagtggagcttcaccagttggtgaacacattattgtgctggaaggatgatgtgtcctgattctacagggaaaggtcacgtaagttttgtgtttaggaccctcccagacctcatcctatgcatcttttcatttgtctcttcctgatatgtatgcttaataaaattgtaatcataagtatagcacttttctaggtctgtgagtcattttaacaaatgattgaacctgagggcattgtggaacttcgaaatttgtagccagtcaatcagaagtgtggataacctggggacccctgaacttgctgcttgtgtctgaaatcaggacagtcttagagaggactgaaccccttaccttgtggaacctgtactaattccaggtggttcatgctgaaatagaggtgtaatacactcagctgatgtcaaaatagtgaggttttcttcattatcctttgcaatatttatctgactctttcattccagttttttccaccttttttttctgggatgtctttattaattatttcttcaaatattagctgccttctgttttccctctccttctgaaatttttattttaggcactgggtgccatgcatgaagtttgttgggggagtgtctttggaacaacacttggtaaggaatgaagaaagaattaggcaggggcagtggcagaatttgccacatcacagccaaggtctgtcgatctcactgggagtagggatggcctctttgaattgttctcagttaaggctctaccagtcattggatccaggctgccctcaggagggtgtctgattttggatgaagcagctctcttcatctaaactggagagggactcaactgagagttggcagtcaccagtcctcccattgagggagtattgaggaaatgagcacttcattacttaaggggaagaatctgggtcggagttggctaacaacagcccatgtgccaaacccagcccacagcctgtttttgttaaaaaaattaaataaataaataaataaataaaagcttacttggcgtgtctgtcttcacatagcctttcctctgttcatgtttgtctttaacgtctcccctcttcttataaaggcaccagttgtattggattagaacccatcctaatgatttcatcttgattatatttgcagagtccctatttccaaataaggtcatatttacaggtaccgggggttaggacttcaacttatattttgggggagggaaccacaattaaatccatgggagccagaaaatgttttcatttgccatttaaggaaacttctgtaaggaaaaaccccatatccctgttgcaggtgtgatggtgaagcaggtgtgagagctgagcaggcaggagttgcacaagtgattcccttgtctattacttgagtggccagacaccaggaggcagcaagtagatttctccaccgcctctgactactgaagccctgggagttgcttaagcttatctactaaccaccttgacaggcttgtaaaaattttgcaacatcattcttaaaaaagaaagaaaatccagcagccagcaaactgtccataacagagccaaatgactcactgccagcactgctctacatgttttaggaagtccttatcatctttccaccaacacatccaattattttctaaagcagctttattcccagaggatgcgtttattttttggtgtaatggcatctatcccaaaagttaacccctgatggttaccaagtgagaggtatctccagaggcataatggtcagtgtttaaaaaccagcactccaaaaagaaaagctggggtgggggggatgtgctgatatagtctttgccaatttccatggtgtaaacactcccacaatgattaatttcaaactactaatgtgaagtactgaacacagaattgagaagagatatgtacagttagctttcatgagctgatatgaagcaacttcagcacatcactgaatatctcaatatagagagaaaggagtatgatttgagatgtacagggaagacattctggaggaagtaggatttgaaatggactttgaagggtggctatcatttggtggtatctctagcattacacagccagccacatcagtttggcaatttgcttctgtcctactaagactaaactatgagattcctgagggcagagaacgtgttttattcatcatagtaaccctacagtaggtgtttcacaagtatttgttgaatgcaggaatggaaaatgaataaatagagagggcaaaggaattttaggcagaggggacattcacggtgtgggtaggacagagtgggaaggaataaatgaacaggaggttttgggttcagtgagtggtccatacttggagtatagtgttgggacatgtggtatttcagttatttatggctgtgtaacaagccatcaaaaatttaatgccttaaaacattaacacatttgttttgctcataaatctggaatttaaacagggctcaacaggatcagctcattctggttcatatggcatcgactggggtggcctgaagactgaggctataatcatatgaaggcttgctcactcatgagctgggaagactcaaagagctagggatttgaatagctgaggcaccttgaatatctgactctatgagggctccctgcatggtgtctccagtatggcagcctcagggcaactgcagttttttgtaccagctcagggctcctgagatgtatatcctaaaaagagcaaaccaggaagaagctgtaccctttggctgacatacccttggaagttacacagcatcactacaccatagcccctactcagattcaaggagcggaaacccagaatccacttctcagtgagaagagtgtgaggaacattgtaataagaccatttgggatgaaacacattttttatatatgcgatatatacatatgctatatattttccatgtatagtgtgtgtgtgtgtaaatacattggagcggccaccattggaaaatataatctgccacacatagtagatggaaggttgaaaagttggatgaggccaaattggaaggggtcttgaatgtcttagtaaagagtttgctctaagacatggaaccaacccaaatgcccatcaatgatagactggataaagaaaatgtggcacgaatacaccatgggatactatgcagccataaaaaggaatgagatcatgtcctttgcagggacatggatgaagctggaagccatcattctcagcaaactaacacaggaacagaaaaccaaacaccacatgttctcactcctaaatgggagttgaaccgtgagaacacacgaacacaaggagggaaacatcactcactggggcctgttagggggtagggggcgtgagtggagggaacctagatgatgggtcaataggtgcagcaaaccaccacggtacacgtatatctatgtaacaaacctgcaccttctgcatatgtatctccgagcttaaagtaaaattttttttttaagaaaagggtttgctctatttttcctctagaagcaattggcatactagttgctgatcctcccccagggttccacatatgtaggttcatcatccccagcaggtctgcaagactaacaggtagcatcatcatgtctttttattttattttatattttattttatttgatgtggtctcactatgtgtcccagcctggtctcaaactcctgggtttaagtcatcctctcgcctcagcctcccaaagtgttgggattacaggtgtgacccactgcatccagcccttagagatcttttgaaaaaagaaacctccctctggctgggcacggtggctcatgcctgtaatcccagcactttggtaggccaaggtgggaggatcacgaggtcaagagattgaggccatcctggccaacatggtgaaaccccatctctactgaaaaaaatacaaaaattacctgggtgtggtggcatgcacctgtagtccccgctacttgggaggctgaggcaggagaatggcgtgaacctgggaggcggaggttacagtgagccgagatcacgcccctgcacaccagcctggtgacagagcaagactccatttccaaaaaaaagaaaaaaaaaaccttcctcaaatgtcagggctctgcatttgatagcacctcagtacttgaaatccaagtgtctatttgcccaagcaaataatgatggcaaatcagaccacactggacatgcttcttgcctgtctcccagctggcacaaacctgcatctcacttgggcaggtgataatggggtggcctgtgatgggctacactggtgacagcactgagtatcaaaattgtcagagcacatctagattgactctgggcttattgcccaacagctcaaagaagaggccaaatccaccgtgttgattcttgctgaacacgtcacacctaatgctgattccatctgccaagggatgctggatccagacagaatgcaatttgcattcacagaccccaaggtgctagtcacttccattcaaaattgtggcctttctctgcagggtctctatctagcctgtttgaagaattcgaggtgaggacacactaattggctttgactgtttttctgagacacagatggggagaagctgccactgagttttggatgagtgtccttcgtctctgtcctccattctttgatgacttctctccttgcaacagtgagaaatttgtttctggccataaggcagttgttgggaggaatcctgagacagtgtgctctttcccatatttgtcaaaccacagatgttccccaatggagagaagatggttgcaggaatacagggaagacattgtaattaatacacaatccttcctcttgctcccgacttgaaatggtctgcgttcaaaagtctggaactaagaacacacattttcccatagaataacagtgccaggccaggcccacaaatgcacatttcatctataatgtgagctgagagagaaaggcagacatcaaccagcagacaggttggctcagcctaagtgcttgatgcagctacctaagctggttctgccgttcacagtttttttccatttctgaaatttggagccccaccagagatttcttaaaagctgcaagctctaatggcaaaggcaatgagggtctgaacactggagtggctagtgctaagtatattcatttgtaggacaggatctgcttgcactttaaaaaataatgaactgtggcttcaggtagctgacttcaggaaattgatgtgtttttaatttgtttgtttgtttgttcggtttctcaatgcactagaaagttttcacaatgaaaccactgagatgggggggtgggagtggcagggatgatgctgctccttctgaggcctgtccaataagctgattaactccgtcggcacacgcccagtgctaacgcaattaagctcacgcttgcaatcccccttagagtggccatttcgttttgcgcttagaaaaagtatcataaggccacaaactatgtatttaagcaggcctcttgccacttgtttgccacagctctgcaaacaacctgaagcttatactgagtgaagataaagttggagaatacagagtccctgttgttcagtgaattctgtgttaagtgctctgtttggaaacagggaattttgctgaatgaaacatcttaactgtaagattccctgtgtgtcatacacccattctcattgtcagagatcaggaattttgtttctcttgtatctagcactttctacaattaacatacaaagatattaatttggcaatttccttccttccttgcttccttcctcccttcctcccttccttctttccttccttccttcttcctttctttttcttttctttctttctttctttctttctttctttctttctttctttctttctttctttcttttctttctttccttccttccttccttccttccttccttccttccttccttccttccttccttccttccttccttcttttctttcatgtgcacaacttaaagtttggatatatagatatatatatctatatatccacagtgagttgattactagtcaagcagattaacatacctatcaccctatgtggttgcctcattttttgtgggtggttaagagcacctaaaatctatcttagcaaattttcagcatataatacaatattgtcaactatagtcctcatgctgtacattagatccctagacctattcatccctatataactataactttgtatcatttgatctacttctccccatttactccccactggtaactactgttctactctctctatatttttgactttattttagattccacatatgagtgagatcatgaggtatttttctttctgtatccagcttattccacttagcatattatcatccagattcatccatgttgttgtcaatatcagtatctccttttttatgctgaataatattccattgtatatacaccacaatttgttttccagtcattcatcaactgacatgtaggttgtttccatgtcttggctcttgtgaataatgctgcagtgaacatgggagacagatgcctttacaaggtgctgatttcatttccttttggttcatacccagcataggggttgctggatcatatggtagttctatttttattttctgaggaactttcatagttttccataatggctgtaccagtttagactcccaccaacagtgtaggaggcttcccttttctccacatcctcaccaacaatttttatctttgtctttttgataaaagccattctaacaggtgtgaggtgatatttcatcgtggttttgatttgcatttccctgaagattaatggtattgaacaccttttcctatacctgttggccatttttacatcttctttggaaaaatgtttatacaagtcctttgtctattttaaattcaggttatctgtttgtttgtttgctgttgagttgtttaaattccttatatattttggatattaaccccttatcagatatatggtttacaaatattttctctcagtctgtaggatgccttttcattttattaattgttttgtttggtatgcagaaacttttgtttgatgagatccacttgttttcttttgcttttattgcctgagctttcagtgtgatatctaaaaacattcactgccgaggccaatatcaaggagcttttcactatattttcttctacaattttatggtttcaggtcttacgttcacgtcttttattcattttaggttgaattttgtgtgtagtgtaaaataagggtccagttttattcttttgcacgtagctatccacttttcccaatgccattgattgaaaagattgttctttccccattgtatatttttggtggccttgtctaaaattagttgaccatatatgcatgggtttatttctgggtgctctgttctggtccgttggtctacatgtcggtttttatgccagtaccatagtgctttgattactctaactttgtaatataatttgaaatcaggaagtgtgatgcctccagctttgtttttctttttcaagattgttttggctatttagggtgttctgtagttccacatgagttttagaattgtttttcatatttctgtgaaaaatgccactggaattttgatagagattatgttaaatctgtatattgctttgggtagcatggccattttaacaatattaattctttcaactcatgaatatgagatatctttccattaatttgtgtagttttctatttctttcaccaatgttttatggttttcatataaggttcggatcttttacttccttggttaaatttattcataagtactgtattcttttttaattaaaatttttaaacattttaaatgcaacacttcacaaatttgcatgtcatccttgcacagaggtcatgctaatcttctttgtatcttttcaattttagtatatgtgctgccaaagtgagcacagtattatattctttttgatgctactataaatgggattgttttcttgactggcaattgttgccatccaacaatttacatgcttctggcttgaattgcagataagctccttcagaggagtaagtgtcttactaccttataatctctacagtactttctagaaagaatatgcttatctggtatcagttgctttaaattcagtggaatacagtaagacagagcattcaaacaatactagctcaactctagtggtacctggaatgtttagaatgtgccttattttcaacagtatgaccacagcagctcatcgactgtgagcatgacatcaatgacaattaaagcttgcctagaactttgtgtgtgcctagcattgttttaagtgttttagctataagatgtcatctggtcctgcaaacaatcctttgagggaggggtcttgttacttatttttaagtttacagatgaggaacctaaagcatagagagattaagaaatgtgcccaaggttacatctctagggaggagcagactcaaacacaagcagtttagctccagaaaatgtgttctacttactgagttataatgctcttttttcaaagagctaacctacatataaggaaatactatataccaggcactttttaatgtaaactcgtttaatctcaccacaagcccaagagatgagtactactgttatctgtattttacagataaaaaaactaaggcacaaataagctaagtgagtggtagagccccatttcaaacccagaagatctgatttccaagtctgtcctctcaatcatcatgccacagcactctcagaagagtcagaggcaaatagaatgccaatcctgaattgatttatgtagatttacatagcaagagatggtggatcataggctactttataagaagaccctcccattttccatcaaggctgaacatcactatatttagggacagttgtgcctggggatatgcatggtttcttcccaaataggctgggaaaatagtgccaggtgagaaaaaaaaagagtttgtattttgcttggagtattaagataaggagaccaaggtccaggggtatttgttttttcataagggtaaagataagggagaagcaaggagagacgacaagttggccctgctgtttccctgtgctttgagcttgcaatgtgcagggcatgagattgggagcagcccaggtagaagatggttcctagcataagatggggggaaacggggatgaatacactggtgtttgtctttccctagactgaatggccactctgctcccagaggctaagaaatggaatgcctaataggtaccagggagactccctgctttgcagcttatagccaacttataggaaaaaaaaaggtatgtgctgagcagaaaccataatttatcagctgtgccttacctagccaatgggacactttcctttttttttgatcccttttattagatgaggaaagaaagggaaagcaacacataaaatgttgatttgaaaaagaacatgatttcttaagaagaaatctgaagcctctcagctagggctcacctaagaatcaaagtggcacagcattccatcagggcccaggaatgaccatcaacttattaaggttgtgaagctggaagttttcgtaaagacctgccatttgtcacaggacctccttcagccttttccttgatatccagaaggctggatccttaggctgtctaccagatggcattccagtggggagggagggagaaaggaaggaagggaggaaaggaggaagggaggaaaggaggaagggagggagagggggaggaaggaagtctcccagttacatattaatggcttctcagggtctgacttgtctttgctcctacactcatcttgccagtgagccctgcaaggaatgtggacagtcaagctacaggctgctggccatggaccacctcttgggtagacgagaagagacacatggtgggtgttttacagacatgtaggtaggaatttgcaaattgaaccagcaagtgtctggtacacagtaggtgtttactaatgggagttgatactgctattgacaatgtgagaatgagtggctgcaactgtcatcccactgagtgaaaagcggggttgattcagctgagccatctggcaacacgggtgttcttccttttttaagaaagttttgttttaaagtattatgaaatatgacacacagaaacccataaaccataagcaactgcataaggaaaaataataaagcaaagtatcatgtaattgctaccatggaactacttccctggttaagaaatagaatattgtcaacactcagaagctgacaccccaccccatgggtccttaccagtcatgcaccttccccaacccacaaaagctgaccttgatcctttcatggaaacgacacatttgcttttaagtaaatatatgtatgaattgtatatatgtactctcttcatatgacctatatatccacatataaaatctatatatttctaaatattatgattttgtctgtttttgaatcttatataaatgcactccaacatgatcttttgtgtctcacttctttcaggcatcattatggttgtaagatttaaccgtattgttttggaagtaacagtttattagttttcatggctttctagtagctctttatatggatatgcaacactttgtttatctattctcctttagatggccatttgggtgtttttcaggttggtgtaattactgacaatgttgctatgaacattcttttatatgcattctggggtatatacctaggagaggaattgctgggtcacaggatatatgtgtgtctatgaataactctagtagaccctgccaaactcttccgaagtggttgcataaatttgctctttatcctcaaggtacaagagtcaccatcatttcacagcttcatggacagatggtactggttgtctaaatgttagccagtctggttggtgtgtggttgtacttaattgtgattttaatttgcatttctctgattactaaagaggttgggtaacttttcattgttttttgtccatctggattttctcttttatgaagggcctgtttatttctttggcccatttagaaaatggggttgttcaccttttccttaatgaattttatccagatagattcttgattgtctcaagaggcatctattgaaaagagtggtgtcctgaagtccatgagagttgattgttaaaatttcaggagttttctgagtaggttgtgaaattgctggtagctcaaagtcagccacagtgttgataccatggaaactggcaaatgcgatataaatcagggcattttccgctagagagttggttgattactacaccaatggaaaagcccatcttttctgccctggctcacgaggccatcgctgtcataaatcctggtcatacacatatggatttatttcactgctatctcttctgtttcattcctctctttgtctatccccatgtcaaaaccacactgccttgtaaactacaggtttataataagtcttggtatctggtagagtgggtcctctcatctcctaagagtatcttgctcattcttggctcttgacatttctctgtaaatttagaatgagcttgccaagtgtttacagaaaaatctgttgaaattttaattacattgaatctatagatcaattttgggaagaaatgtatgtttttatctgctttgagttcattatggaagttactcattactgtgtaaaatcaattgcatatatattctataagctgtcatttgttatttatctttatccacagtctttcttgctctattggtccattttcttactgctatgaagaaatacccgagactgggtaatttacaaagaaaaagaggtttaattgactcatagttccacatggctgaggaggcctcataatcatagcagaaggtgaaggaggagcaaaggcatatcttacatggtggcaggcaagagcgcatgtgcaggggaactgccctttataaaaccatcagatctcatgaaacttattcactatcatgtgaacagcctgggaaaaacccaccccatgattcaattacctcccactgggtctcacccatgacacagaggaattatgcgagctaccaatcaagatgaggtttgggtggggacacagccaaaccatatcacttgccttgcagaacttttacatttttgttaaataaagttcatcaaacttttcctttatagcttctaggatatcgctcctagtagccacaaaggcaagccacacaaaacttaaaatgtaatagtagccacattaaaaaagtaaaaggctgggcgcagtggctcacacctgtaatcccagcattttgggaggctgaggcaggtgaatcacccaaggtcaggatttcgagaccagcctgaccaacatggcgaaacccctctctactaaaaatataaaaattatccggcgtggtggtgggtgcctgtaatcctaactacttgggaggctgagacaggagaatcacttgaacccaggaggtggaggttgcagtgagccgagatcgtgccattgcattccagcctgggtgacgtagtgagactccgtctcaaaaaaaaaaaaagtaaaaaaaggtaaaattatttttaataatatattttatttaatccattatagcaaaatatgatcatttcaacatgaaatcaatatataaaaactattcacgagataatttacattctttttttcatacaaattcttagaaatctggtctgcattttatatttcagggacatttcagtttggactagccatatttcaagtgtttattagtcacacgtggctaatggctgccatgttagatagctcaggtcagtttctttgttaaggcaggtctacagcagtcttaggtctgtggctagtttagtgctaccaagatctggcccttccagggttggttcagtgaggtctcttcactattgttggttgaaactttaatgtttcacagctctgtgtgactttgggaattgtttgtcttacagcccctgaattaccccctagccctgcaagttgctctttcttcagcatattttgcctagctcttggagtttcatctgcacatgcccatttagtatttggcaaaaggctcaagaagacttctgcatagctctctggaactctttctctgtgtagtttcctccttttcagtactcttcttcgtagagtccagtagcctcctcctgaattccagtctctgactccccaactcagtgagatgactgtgctctccttggggttccttctctgccccatggtctgcaaagtgcctccacacagcaggcctgggtgatcccagggcttaccttattagcttatcttccctgagagatcacaatccatgctgtggtgtgggtctggggttgtgcacaggctgccagcctaatactcattattcttaaggccagaagcagaggtcctacttaaaaaaaaagtcttagctggctgcagtggtaaatgtctgtagtcccagctactcaggaggctgaggcagaaggatcacaagttcagcccaacctggacaaaatagcaagacccaccatctacaaaagaacacaaaacaaataaggttttgagcttacttattagttttactatctagttatttcgtaattactttgatctttattaatcgcttcttacagtcttctttaatattattctttttataacttgatgtatttttattctttcttattagaaataattagggctatgagtttttctttcagggattcctttagctatttccacaggttctgacatgcaatatttttgtggtcattattctctagataatctgcaatttgggttttgcttttctctttgacaaagaattgttccagagacttaaaaaaagtgtattttgagatggtagagttttatgtttcagttttctggttttgttattaattttagttatattgtattacaaataaagttatctacactatttataatttttgaagatgttttaagttttcgttgtagcttaataatcatgacaaacctttgtaaacaagatgttattcactttttactgtaaattgtttatcgactttaaatgagtctgttatcaatgttagtatataaaataaatttaaatttacaaaaatataatgcgtgtgtgtgtgtgtgtgtgtgtgtgtttactctgggtgccagtgtaagattatatttcaaaaatgagattttttttctaaaaaaatgtgaaaaccactaggcaatgtgacttcaaaagtcatctagaatgtgtagaatgggaatataaatttgtgcaggctctagagtagagtgagccttgagttgtgttgagatcaaaggatacccagagtatttttttctttcatttttcattcattttctttctttcctctacacaatatgctaataaaacatctagattacacagaccgaggccaggtgctataccagtctgttatcaacaagtgagagcacatgaaaccgtttttaattggccttaggaaaagcagaggtgaaatgaaaatttaattctcctggaccttttttcaaaatgtatttttccatctctactgtaaagagtgcattttaattaggttgattctcactgtttggccatgcatttgtaatctgtgttcactctttgggaaagaagaatttgatgaaaggaacctgataataatggaaatcttgtctgagcagaacaaattggaattatccaatatgatagggatgtgagaagcattgaggctggtgactgaaaaaaaaaaaacacctctccccaaaacaccactgttctgcctagcacagtcttgtcctggcacagggagacagtgcaatagcatggaatgtgcttttggtgcgtctgggcctttctggtgcatcacaatcccccatcctcaatttccccgcctgtaaaatgggggtaataatctccactttgcactattgtgaggattgagagaaatgaattatgtgaaagtgcctgacatgttataggggctcagataatgagtaagaggagaatttccaaggaaagctctatggctgggctgagggtgaggttcctagtttgtttacagctttgaaaagaaagaagtgagcaggggcaggcatttacgtgtaagtgagagtgtgtgtgtgtgtgtgtgtgtgtatgtgtgttcagggcaggggaatctgtgggtacatcctagtacagtccagtgtttctgtgtgtgccattcaggatgaatttcctgtgggatagcaaacaaccaggctctgccgtagagaagtcgattcagagtcctcatctgcaagtagaaaagccccaggagtccatgcttacccccattacgctactcctgtgagtgttgtgggacagatgaaaggtcagctaggtccttcagctgaatgcagtgcactaatgaggaaacgagttaggagtttctccaccagtgccaacaagcaggtcaagtagcacacatcgggggtggagaggccgcccacaaaacacattatttagggtgctatgccaacctgtcagagagggaaaagatacacttcttggctttggagcttgtgatttaacagaacaaagaaagagaaaacatgaaaggcacatatgaagctaattttaaagatccagtggccatacagcattttttttttctcctagacagcattaaaatcaaataatccttgaggtcatcagacaatagctccagtgcactgtgcagaaagtacagtcctggccgggcgcagtggctcacacctgtaatcccagcactttgggaagccgaggtgggcagatcacctgaggtcaggagttcaagagcagcctggccaacatggtgaaaccctgtctctactaaaaatacaaaaaattagccgggtgtagtggcacgcacctgtaatcccagctacgcaggaggctgaggcaggagaatcacttgaacccgggaggcagaggttgccagtgagccgagatggcgccattgcactccagcctgggcaaaaagagcaaaactccgtcccctcccccccccaaaaaagtacagtcccatgtttctatgtgcaccattcaggatgaatttcctaagcacctactgcattcccagaattaggagtacaaactcaggggtcagactgatctggattaatttccaagtctgtcactaaccattttttaaaaatcatatatatttaaggtgtgcagcatgatgttttgatatacaaagtgaaatgattaccacagtcaagcaaagtaaggtgtctgtcatcttccacagtgactttttgtgtgtgttgcacctaaaatggactctctctgcaaattttcaatctacattgcaacattattaactgttgtcctgtggctgtatgataaatctgtagacttattcattttgtcctttgacctacatgtccccatttcctctccctcccaggccttggtaaccacctttctactctttgtttctatgtatttaactttattttatattccacatctgagtaagaccttgctctcactcactcttttatggccttggggaagcataggtcctccagacagcagaattgcttcatctttaaaatgattgcatcgatgtggcgattgggataattcagagatgttttcagcacagagggcttgtgctaggcccctagaatgtacagataaaggggatccatgttcttcctttgaggcagaggttctgactttgactttgccactccctggcaaggggcatttagcaatgtctggagacatttggctgtccctatggatgtgtgtatgcaggtgctaaacatcctagaacgcataaggcagccttcctcccccttcattgctcattccctctgattgtggaattaaaagacgaaaatgggtccattcgagggaaaaggtcatgatccttaatgctgtttttacatgacggccttgtcagagccttcagctcctcctgctgtcttcgacgttctaggcacagctccctccggagggcatgcttcccacctggggcttgctggcggagtgccatcctcatccatatacatgtccccaattaaaagacgtcccgctgccgggaaagcggctgcaccttggagcgaaactgaaagaagagaccccggggtcttcgcgtccctccgtgggaaggcgaggcagggccctgcgcagaacaccggcaggctctggggaaaggcagggattctatagtgaatcctgcaagcctgcttggggccgacttcctggagcagcggctgcaagcagcgcagagcccagctgtccttggcaaacaccccacagaggaggcgagggcttgctggctcctctgggacgccccggtcaagccaccaccaaacgggccgtgacctcgccttcgaagggggcccccagggcagcggtggacgtgggggcagtgcgggcgagaggaagtttgtctttctcccagctcgggagggtcgccagcttccccggggctgcacctccttgggacgcttgtcgggttggagcgccgcagctgcctctgcggctgccgcctgggtgacggagggtggggcgggggtgggtcgctcgtagctcgagagccacgatctgatttcagggaccgtgcctatgtgctgagtcaaaccccgccgctgggctgggtctgcagccgggccgctgagcacaatccgctgtggttaatgattaatcgctgaccaccccgcctcccgcagctcgggagagggtgctctgggaatgtggaccggggctctcaagtgccggcagctggaaaggaagaggagtgctgcgaggcggagtgcgccctcggcgaagaggggcagaggcggagcgccaggtgctgcggtctcactcccagccagccaggagtttagaacgttcttcctccgccctctccccgcctcgccccagccacatacactcccaaacctcaacacccaggcgcctcctgggcctctcctaggttgggctgctccagcaagtttccatgaaagcacctgaaatactaagttaccttcgcgaggagaactcgagtgagataaaatcgtgcgcccacgcaggtgagtttgcagccaagaattttggacgctgctgggaggagaaagggaagttgagaaagtctttggacctggtagcctggtgctctttctcatggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgagtgagtcctaagtcgggggcaacacgtgagcagcttcccaaccttcccccacgacccgtgccactgcctgtggccctctccagggcaagtcttgccctagaattgcacacttaagtttactaaggtggaagagtcttgtagcagtatgagggcattgctctgggtctctgaatgtttcttctctgtgtttcggggattcatggtagattatggtgaaaagagcacgagaccagaacccagaaggtttgggtatattccagaacatcactgctgtgacctttgggaagtcacaaaaatctttggtaaaatggggacaataatactagagaatatgacggacaaattaggtaatgcaggacaggtgaaagtcctttgcaaaagaccaagttctgcagagatacagggaaccgtcttatctagctcttttacccggggaagactttcttgtgcaattagattttgttcccatttttctcctcctttggagaaagcaggctgtgagcgacacacactctcgggctgctattttattccttggagcctcttcgacccaatcttaagacatgggagctctcagcactccccagggcttgggtttctgccactgtgggtctgttccttaccagaccagagcaacctggcaggacggcctgtttatctgatccagaaaatctggcttcaccgattcctaggatttgaataatcacctcacagacccaattcttatgcttgttttccaaacttttgttgtgatacaagtatttaaagttgaggcctcgtctatttaaaaagagcccacaggtctgttgaccccagagccttcagaagagggacctagtggctgggagacaaggctttaatggagacacatgaaatgtgtgtgaacaaagggttttaaaatatatttttttagcagaaacaataaaaaggatgtattgtgcgtgtgtgaatcaaaaaggaatagatataacaaacatttcccttcttccctctcccctgtggcatcaggaaaaggaataaatcatggtgctgtttgttttggtgtgggcaactgggcagcaggttccagggacaggaggtagacatgagagagagttggaaggcacttggagaatgatggaaagacctgggtcttgcctcagaccagcccctggcttccagtgtgtcattaattgttaaaagcttagggtctaattttactctttattcgatttgaaataattgccctaatgaatttcaaagtactcagaggcagccatggattgcccccagggagctgggctttgagagctgtggcaggtgaccagctgacttgactttactctgtgtctgcacaaaatgagaatatttggatgctactctgcattaggggctgtgccaggtgactgatatttccatcttctagaggaggaatttgagacttagagaagacctagttcagaatcacctcagtgcagctcaaagagtcccactgtgcttttcagggcagagaaatgcatgtctgtttgtgactttcacaggcgtgtggtgaaaggaaaatgaaacaaggcaggactttgacaagcataggtaagcctggtggtgttgctgcctcttagggccagcctttctggaagttgtagtaggtaacgttatcttgggacttgggaagcgtacccaactcagtctatcacccactggttgctactactcaaatattacagagaggaatggacattgtatttgcttaaagcttgagtgtttgttgaaatactagttctcccttcctccataaatattcccttaggcatatcttaaactgtaaggtgtaatttatactttagtgtgagttaattaaatttcctttttttttgatcggaggagactggcatgagtggataagaattagggggtagataagcattagcaagtggtcttcaagtatctcccagtctaacttaggaattaaggctgcctttgaccaaagggaaaatcattgatttatcgttactctatttgaccaatctctgtgtttcctgtatttctctgagtagatgtctgttctccccacagcaggtgctccaagttaaagccagtctccatttgcagcataaaatcagaatgccacagacttttatttagagatggataggaccttggagatcatcagatcccattagtaattgtctggaatgagtttgttcttgctgctgctctcgttcttttcttctggctctttccttctttcctataccaactgtatgttaatcgcccactgtgttctcagcataaagattgttgaatggcaatcaggtgctcaatgtgcgataatgtcctgggggaatttaccgtttgtatttagcccattttctctgcggtaggttttcaaagcagttctcgcaaatgtcctcctctcccaatgaatttcaaagagcttttaaaaataggaacctcactaattaactcaagttaggaaataaattaatggagtgaagaggaagaaatcatggcctgcattcatcagattaattcaatgcaatttactttgtaagtttcataaaacttgtgctttggggcatttttaacccagaacaaatgaacatataaattgtttacaaatcgctgaatttaatatagtaatttagttgtctttttagtatttcatttcacagatgggtcaaattaaaataaatatttgcttatttcaaacattttaaatttaatgtgaaatgtaaatggcgacatatcacaagtagttcttggagctcttaaggcaataaagaaaacaattaagattgttcgccgctcgttgttaaaaatgctaacttctgcatgacagaaacaaaattcataaatctacgcaagatgaggaagcccatgtaaaaaatattaattttccttcatctttcactattgtgcctcagtctagtcgatgtgctgggctggtgaataaggaaaacacattgggaactctgggagagaaagagaggctgggatacctactagctctcaagcaatttacaggagaacacaatagtgatgcaaaagtgcacattcctggaaataggagtgtcttgtcttgcctcttgtcagcccagtgacaaatcagtactagacttggtttctgtttcaaggtttcagccagtgtggcatggtaatatttgtccgatgtcagaacagaggttgctggtctggatttctgcctcttctggaggaaaggaactgataatttgattatctgtcctgtcccttcaatgatgaggatgtgtaaaatgagacttcctttcaagcaagtctttccccagacctcccatcttctctttctgaagtctcctttggagttgttctcaatgcagatagcatccaggtctgtggacacttgtgtgtgtctattgcacacatggcttgctatcaagtgtcacccactcaaagtggaatgacaaagtaattttaaaaaaagcatagttttaatttgtataataactttcaagtgattgggactcagctgcaactacctcctagagaactagagggcagtgattggctttcaactatagttatgaaaaaagattttacagacagtcatgaggttattaaataaaagaaacatcatagaagattcataactctagaataattacactcttttgcattctgatttgctctcctgagtcagaaggaaagggaagaagttacatctagtggcagggattacacatcaacttggtttgctcatattgaatatagacattattcatcacgtgtatttggatggaacaaaggttagcagttgctgctgaaatgaactactctaaaaataaggttgatatacatttagatatttgtggcatggttcagggagaagcaaagagaaggagctcagaatcacatcctctgggtttttagaccacagaattaggtcaaaccaagcagggccagggaagaagaagagagagaagagagggtagagggtagaggggaatgagatattgacagtgggtcctctttacctgaggacaatcgttacctgaaaagaactcataaagttggttcctttaaagtggggttgaaaacatttgaaaagaggtctcattgggacttgaaagtgaaaattatgaaaagaaatttatttgtatgttacaaatataagttatagttacaactatatattaattcttataatgattattcagaatgaatccaatgtggcttgagggcacaatttttctaacaaaaccatctgataacctttgtgttttattttctcagtaagattataaaaagggcctctcttcattctttgttatttaaatcaccctcatggaagcacctatccttgcattatccttatcagttttccattctttcataattatctggtctaattcgagcaaatctttgcttgtcagtggcgtggcatttgaatcatctgtttcttcagcttccttttcattgacttcatgaaattctgtaccctgtgtgcaggccataaccaaaaatataattaatttaaaaaccaatccctatactctactgtatatttcgtattacacagaagtggatgccttgaaatgctttgacagtgcccataagaatttttagtagttgttttcttcactaggttaaatgcttatcttacaatcatgttttcatcattagttttcttagcaaaggctttttatttgatatgaaaggatatgtcaacacagtctttgagggaaataccatcaacattaaattagtgacttttttagtgtaagatattattttgactccaatgtttcaatatttcagaaaaaagttttgcctcaaatattttatgtttattaccctatttgtgatagctttcataaattgcaagtgtcctgtgatcagcctggcagacaaatataataatgctgcattatttttataatcaggctgtctcaaagatttcatttctctgttggagagatgcatagtttccgaggaaggggagattgaaatcccagtccccatttattagcaagcctgttcatctgtcagcctcctgggggctgctgaagtgtaataagagaggcctcagttgcacaaagcatttggcttattagtgctaaaaccattcagaataaaagccatttacgagttgagacagcgccgtggaagaatattgaattgggagtcaaggagcccctctggctgtacaaggcaaggtccgctggtctaccatttggaggacactgtcgactcctatcccttttccctctgcacatgtcccctgccaggctgcagccctgggaccactcaactgactctccacctctactcttggctatttactgaggactggagacatgattggtcatcctttctgctgcacattcttgtagatgaatagctgtcttctcattgtgtcctgacctggccttctctgcacatgtgttctcctggtgtctcttgctcttcttataaggatgctggtcttatcagattagggccccacccttacaactttattttacccgaattacctcccaaaggcccaatctccaaatacaatcacaccggggcttaggccttcaacatgtgaatttgcaggggacacagttcagtttataacaccccttaactgccttattccactggctccccttcaagttcttcaagtgaccatgactggctctcttcccccatgctgcctgtgtatgggttgtttcctctgcctggcatgcttttctatcttactctattctctacctgctccccacttccatccccttccccaggttaatatctttctcctctctcagatctccccagggaaactggcccatcctccctgacttcattaaacctcccacaaaacaagactcactgttgtcattttacatttaattgtgcaattactcgactgatgtctgtcttccttctaattccttgtggataggtgcatgccctaatttccctcaacactgtacctcattccagcatagtgtctagacatagtaggtaatgaatatttgttgactgaacaaatgaatgaatgagcctcagcttggaattgagaagcaatgttctgttttcccttgggcatgcattcgtatagaggtttatcattcctcaaaagtgttctggttcatctgaaccaaagatgctatctttgaaagggttatgattcctctgaggcctctgaagtcaaaccaacatgcaaaacatttaagatttgcttgcccctgagcaaatgaacactatgtgctaatcagaccctgaatgttagctttaaccatgtatatctgccagaagtaaccgtgagatgaaagtgactagggtggtgaatggtccttgttaaaatctattgaacaagatgttaaatgcaatgatacaactctacacattatttcttagcaggctctttcaccactttttaacaaggggtcctcaaggtaatgaggatacagtgggggtgacattttgaaaatattaaaccatgtgtttatgtctccaccttaaattgcatccacttgcagccatctctctcaagagtgagccacacttatcaccccagggtaggaataagcagctactgcctgggacaaaggtgttgtggatccatcctgggtccagaggatggaattactgacctctttagctgggcaattatcttaaaagccagactttgtgaaggatgaaaaaggattgcctaacttcatatctctccctttaatgtatcatgagcccagcctagtggactggatcagccagttccagatgaaaccatagctaaggggtttggaatttatccttggaagccattgcagggttttaagaagttaaacagcacagttggatttctagtgctgcccctagagtgacagcatttgttgcattccaatttgggtcaaagtacaggcctggctgtgtttatagaataaaaaaacagacaacccttcattggaacacagttctggcagagcagctgacactggtgagttctcctttccattaggcagacctctggcccttggtttctccaagtcttgctgctgccactgtcctccatggccagacagtgactgcttccattcagcaactcccactttcccagcacggaggcccaaaccgcccccatgttgctcaggccctgattaggaggtggccctagggagctaaactaggtcacagtagctctcacctgtcatctctattgctcaatggtctattcgttcttcaacgacaatctccagctacgaccaactcatatatctcccatgacaaaacttcctaccacttacactagcattctgcatatgatatatctcagtgcctcccacttcttccatgaagccttcctggactacgacagcctatactgatgttcctatgcatggtgagccatcttagacatttctcagaagggggcacagatgatgtctctcgactatattggaactccctaagatcagggacccttcactgttgtacatcttcaaccttccttactgggttgggggcagagtagccatgcattgcttgagagattgatggattgaagttctctgacagtggctgctgctcctgaaatggaggaaaagcaccctcactgtgatcctcaggcagctctcttggctctaccttcctttccttctttccctgtgctaggcagaattctgaaatggcctccaaaatgcctggtccataaggtatacgtatcttctcccagttattcaatcaaacactaatctagtgctgcaaggaaggaaagtaattaagttcccaaatctgttgaccttaaaatagggagattttctgtgtggatttaaccaagtcacatgagcctttaaatctgggtctagaggtcagaggcaggagaactaagagtcaaagcatgagaggcatttgaccagggagaaattctctgttgctggctttggagatggagggagctggcagagaatataggtaggttctaggagctgagcaccagcaagaaaatgggccctgaataagcttagaggtaaaattcccccccagaacttctagaaaagaattcagcctggcctacatgttgagaacccaggcataccttgcctggatctctgatctacagatttgtgtgctaataaataggtgttattttaagccactaaatttttgataattcactatgtaccaatagaaaacgaatggattcactgaactctgctgaaaggagctcccaggtaaacacatggcctaccttagttataacttccaagacaggttcaatctccagaagcttctctttgaaaagtctcaccttccaagaattgcctttggcccagccattcacagatccaccaaccacttgttggtcacctgctcagtgctcagtgatctggaagtttaacaagatccagggcaccatggaatgttcactggacttttaaactctcgtttggagaattacaaaatttgtgggtttgagtcccactggctggattttcagaatgctgatgccttgatagtcagaaaggaaaacagtattgaattgatcttataattatcatccttttggtagctctatttcgtcatagcctggcaatgactaggcgctgcataaaggtttggtggataagctgatgcctaggcagctctgctgctttccagagtcctcctcaccagaagggagatgcctgtacccctcatcatttggcttcagatggaaaaagtgtgtcagggaggaagccaaccctggtgctgaagcaagtctgaataacagaaatgtcttgggctaacagactttatcattttctgattttagagcctttcccgatttagaaacttgacaaaaagtcttgtttgtacttactgagtgtaagagccattctggcaagcagagggtttaacactcaggccactgctttgcacaccgcaaaggtggctaggtagttggagagcagtggtgttactggtacctaacagacagatcgggaggcaaggctgcagcatcaaagttgccattgtacttgttcagtgtctaactgtccatgaaactaacggcatgcagaaatgggggcaggcccagctgggagtgatgacgctcattaaacttgcagagagaagccactctctttctttagtgaagaggaaaaagatcaactctgctttagaaataaaacactttacacagggtgcttgagccagagatgaagtcatttgaatatatatatatatgtacctatatatataatatacatatataggtacatatatatataatatacatatataggtacatatatatatatatatatatatatatatatatatgaaatttttttttttttgagacggagtcttgctccgtcgcccaggctggagtgcagtggcacaatctcagctcactgcaagctctgcctcccaggttcatgccatactcctgcctcagcccccgagtggctgagactacaggcgcctgccaccacacctggctaatatatttttttttatttttagtagagatggtgtttcactgtgttagccaggatgtctcgatctcctgacctcgtgatccacccacctcccaaagtgctgggattacaggcgtgagccactgcgcctggcctgactttacatattctattctatttggttttatatattatatatgttatatattgtatgagtatgtaatataacataatatcttatacatataattctttggagacatatactcagcagaaataaaatttctggcatatttttgagtctactttctatgtgctgccattctgaaggattaaatatcacattgaaatgacagctacatctttttgttttttcagttacatttggaagagaaggatgggaaggagtctcagtaagttgcctaggctggagtatagtgactattcacagacatgatcatagtgtcctgaggcctcgaactcctgggctcaagcaatccttctgccttagcctcttggtagctaggactacaggtgtgcactaccatacttggcttttaagctgtacttcatatatatatataatatatatataatataaaattatatttaaatatatatattatatatagttatatatattatatatagttatatttatatttaaatatatatatatttaaaagacagctgatgggttttcactgtttttcaagttcaagtttacccttgataggggtgacaaatgagtcaccttggtgattgaagcttgctgtagatatcctctagagaagatgaaaaaaacttctgtaggaactagctgttctccttgttagacctggggttttcctcattattgaatctcttacaagctgacttcctccaagaagcctgcctggactggctttacccttctctcattattccagcagatcttcacatttcatttgtttgttcattcatcaagtatttatgaaacttaagttgtgcttaacatcgtttgtaccatagagatcaaaatgctggttcctcctttcaaggagcttaatacttgtctcattgggacatcaaagtataagggcagagccttgtagaagcctaaatgtaccacttgatgcagggtctgggttgtggctgtttatgaagtaagctagttctagtaaatgttctgccagaacttttaatagactggctaactgggcttcactccagagatgttgttagtctcgatattcacagtatggtccagggacccgcagcatcagcatcacctgggaaattgtaaaaggcagagtattgggccacacccctaccagttgaattgtaatctgcattgtaagcagatccctggaatacctatgtcctaacatcagggtatgagaagcactgatctacaacacttggggattctttaatgtcaatactagaaaagggtgaattgggaaggactaaactcactagttgtgataagaactgtcaatcacttgttgtgtagttgtaacaggtgggaatttgctccatgacacttagacataaaaaagttgcattatttctaaaaagaaacttaaatctggctccaagctctcatttggaaggtggtgaaaatgttaatcttagtaacattgggggtcggggtttcccctttctcatgttgtgtcaaaattcaaggggcttatgagatgcccagaaaatgaggcattgggtctgttgttcaaagttcttcctattgccaattctgctctatgattttgctgccagggctgaccagagcactagggccagccagccaaagggctggcctttatattttatcttcaatcctcatagtatcattagcatgaaggtatcgttatcctcactttgcagaactgcctgaggtcatcaaacattgagattggagctgggatctggcatgttttgcagtccacgttctttacatgagcagagggtgagtctctcaaaagaaaacgctctgtagtctctcaaaagagaatactcttcagtgggggaacttgttttggatggtcagtgtcagggaggcaagaaattatgatgccaagtctggtggatgtttatcttgcttttaggctacccagcagcttttggctgctttttatctctgggaaatttccatctttttgagtcctgcttcctcaagatagtggtcagaagcttgctttcccagcatccctcacagccagagtgcagcatgtggcctgggctgcgccagtcacgtgcactggcatgagagtctcatttggaagagaaggatgggaaagagcagtagccacatggactctctttggggttaaagccagtgtgtgacaaatggggttaaaagagtgtaaaggagcctttagagagagcaaagacagaaaagctaaagacagcatcctaagccagatgtttgcagcacctctacattggtgcattctgatgggataaccttatgtgattctctggccctcctaggggttatatgaaataactaatagcctcatttctggatgaaactggaatgggctctgctgtttgtcctaagaactctgcatgtccagaaagtaggtaatagaatgattggactggagtagggaaatctagaaggtagcagtgatgaatttagactgaaaagtagactgagttaaatatggaggaagttgatagctaggctaatggattcagactatgtattggaggccatgggagccatggaaagcttttgagaagaggagtggcaggaaggagtgcaaaaacactgatgtggccatgtggccaaggtgtgtgttgctggcagagagaggcagtgtgaggggcacaggtgtggaagtgatcatgggttctgatgacggtttgtggttaggtttagtcatgaaggggtggtagttatcaaccctgctaaacattacaatcacctgtggaactattaaaaatgccctactccagtctatttatatcaaaacctttgtgggtggagccctggacattggcattatttaagccttcaggtgactccaatgtgtagccagggttgagaatgggagaagaaggagctggaaaggcaggctgggggtggctggggagaccttgactttagtaactgtgccaaggttctttgactagaggccaccaaaccggattcttcttatttagcaagtaagaaggaatttattggaagtatgggaggtagctcactgagtcaaagggaaggctaaataaagaaccagatttatcagggacctagggagtagaaattcatggaccaccagcttgggctctaccatcaagaaggtatcagcttcaggcatcatcccatctttgttgccactccatccagggatgagaaccttgttggactggctagggctgctcatccagcccctgtgaggctgagatgagggcaggtgatggacagtgccgtcaagactgcatgcagtgagaggcgtggtccccaaaggagacccatgttctacccaggagagcgggttacagagccagggagcagaaacaacagacaccccctgtggggaccttcgtaagcttagtgatgtgctctgacattgttgagttccttctttgttccatgcagactttccccagattctattctctcttatatccctggacttccccttccccctggctgagtcctgggtgatatttcccagggatctggtcatcttagtgcatgagcagtttagaggggtggggaggaggggtcagcagcagagcctcctgcttctgaaatgctgctgccagaagctggttggtgccaaatccccagggcatgtctcctgccttgtaagctgactcactcactcacctaggtcactcactgaccaagtatcaggttgtggctgctcattaccatgaaatcaggttgtatttgaaacttggcctggaaaacaaagatctctggctgtgcttcagcatcagatgcaacacctatttctagaattgggcattttctagttatgtcttaatatgatattggccttaagccaggactccttatttcagatgtaagatcctacctttgatgtcaagcatattgaccatggaaaataggaaacatatgagttgcattcattgccttctggaaatctaaaaagttatttaagaaagaaaaactagtaaaatttattaaagttttgttcataaaatgttttagtttcacattggaatgctgattgatctttgattttgatgtcagtcacattctgtctctagggcagttactgttttctctccctgcaaattgagaggccaggaggctgctctccaaggcagcttctcagagtcttcacttctcttggtgatgtttttttgaacgagagtcaccatacgccaggtgagccttccccgtggaacttggcagtgagctgtgtgcattgagaatatgtggagggagtgtggtgtgtgtggacttcacattcagtgggtagggcctaagtatgtgactactgtatcttaagtggtggggatgatggcaaatggggagtatattagtttcctgtggctgctgtaacaagttactacacatttgacggcttaaaacagtagacatttattttctcacagttctggaggccagaagtccaaaataagtttctctgggccaaaatcaaggtgtcagcaggaccttagagcttaggctttaggagagaattcactctttcaaccttccagttgctggtgactgctggtgttccttggcttgtggttgtgttaccccagtctccaaggccaacatcttcagatttctccctgctctgtcttcaagtcatcttcttgtttgtcttgctccatttgggctgttatatcgaaataccataaactgggtggtttgtaagcaacagacattattttctcagggttctagaggctgggaagtccaagatcaaggtattagcagatttggtgtctggtgatggcctgctttcaggttgcaaactgctgacttctcgctgtgtcctcacatggtggaaggggcaaggcagctctctgggacctcatttataaggacacaaaccccatgagggatgtactatcatgatgcaatcacttcccaaaggccacacctaataccatcacattggtgactaggtttccaacatacagatttgaaggacacaaaaattcagaccatagcatcctctgtgtgtgtcaaatctccctctgcctccctcttctgagaatgcatctgatgaaatctagggcctactctgataatgcaggatcatctctctacctcaaaatccttcgcttaatcacatctgccaagattctttttcttataaagtgacatttactgtatccagagattaggacctggtattctcggaggacatttttcagcctactgcagggagcaaagggataccagaaagtacaaaaatttaatgtggtacatgagcatagccttcccacctacagagagacactgctgtgcataggtatatgtcccaatctcctttccatcacctactagtgtgtgtgacttgacaaattactcaggacctcagttttatcatctctgcattagacataaactggtctaaggttgatttgagcatgcagtgagaagtatatggaggccacctgtgcagtgcctagcatatggtaggtcgtcattgaaaactacatttgacccttgaacaacatggatttgaactacttgggtcttcttatacatgattttttcccaataaacgtattataatactttttggagatttgtgacaatttgaacaaacaaatggtaaagcttagaagtagaaaaaagttaagaaaaagatatgtcatgaatgcataaaatatatgtagattcttgcctattttattatttactatcataaaatatacacaaatcttttataaaaccttaaaatttatcaaaacttacatacacacaaatacagattgtacatggtgccatttgcagttgagaaatataaacaaatgtaaacatgcagtattaaatcataactgcataaaaattagctacagtaattttttgtagctacctcctgttgctatcgaggtaagcttaagtgttcctagtgtccacttgcaactctgtgtgacgctaatcatctcagcatgagcagtttgtctctccagtaaaatattgcagtaaaaaagtgatctcgtgggcttctcacataaatttcatcatgtttagtgcaaataccataaaccttgactaacatcatgggactcatacaaagtgccactagtggtgctggaagtgctgccaagaagtaaagtcatgatatcacaagaaaaagctgaattttgacatgtactatacattgaagtctgcaactgcagttgccctccatttcaagataaatgactccagtgtaaggaccattaaaaaaaaaaattcatgaagccgtcacttgcaagaagtattttgcaaaaagtgtgaggttgtcatgcctgctattactacagctatgccagcaggcatgacaacctcatactttttgcagaatagttttttatattgtattggaaatgcagcttttatgttggtgcaggattgctattagaaatagcaattgctatagactctaatatgattcaagaaaaagcgaagtcattatatgacaacttaaagcacaatgaaggtgaagggcctaaagctggagactttaatgtcagcaaaggatggtttaataattttagacatttggcttaagaaatgacaagataacaggagaagcagcttctgatgatcaagaggcagcagatgagttcctgtacaccattaagaaaatcattgaggagaaaggatatctgcctggagaggtatttaatgcagatgagagtgctctattctgaaaaaaaatgccatgaaggacgtttattagtaagaaagagaagtgagcatcaagatttaaggcaggaagggataggctaactctactgttttgttcaaatgctgttgggtttataatcaggaactcctttatttataaagctgctaactcctgagtcttgaagggaaaagataaacaccagttgctaagtcttttggttgtacagcaagaaggcctggacaataagaacactttttctggattggttatgttgatgctttgtccttgaagtcaggaggtaccttaccagtaaggaactgccttttaaaattcttttaatattggacagtgcccttggccactcagagccccatgaggtcaacactgaaggtgttgaagtggtctacttgcccccaaacagaacatctctaattcagcctctagattggggccataaagacctttaagtctcattacacgtggtactctatggaaaggattgtcagcattatggaagaaaaccccaagtctggaaggatgacactattgaagatgccatcattgttacagaaaaagtcatgaaagccaccaagcccaaaacaataaattcctggtggagaaaactgtccagatatgcatgacttcacaggatttacaatagagccgattcagaaaattataaaagagattgtggatatggcaaaacatcaggtgggggtgaagggtttcaagatatgggtcttagagacatacaagagctaagacaccacaccagaggaaataacagaagatgacttgacggagatgagtgcttccaaatcaacgccagatgacgaggaagatgacataaaagaagcagtgccagaaacaaatggacaatattagacaatctggccaaagcttctaattattcgagactctttttggcttcttttactacatggatcattctatgatacagacacagacactgaaagtaaagcaaacggtgaaagaagggctggtaccatatggaaacatctttagagaaatacaaaggcaaaaaagacagaaattatggtgtatttctgtaaagttgacccgagtgtgcctgcctctcctgctccccgcacacctccttcaccccttctgcctctgccacccctgagacagtaaaaccaacccctccttcctcgttctcctcagcctattcaacatgaagatgatgaggatgaagacctttatgatgatccactttcacttagtaaacagaaatatactttctcttctctatgattgtctaataactttctctttctctagcttactttatggtatgtatacaatacatacacaaaatatgtgttaatcgactgtttgttattggtaaggcttccagtcaacagtaggtaattagtagttaagtctttggggagtccaaggttacatacagatttttgactgtgcagggaagggtgtgttagaccctgaatgcctgcactgttcaagggtcaactgtagttgcctatagtgaccttgtgatattacagaaagaattttggttgaggactcaagagaacttggttctagtcattgccaggccacagacttgtaacattttgagcaaatctccacatattttctcgtgtaaagcttgaagtggtaaacttgaggagtttgtctcaaaagtccccatagacataagacatgaaggggatatgggttccagacttaagcactccaaggaatagaaagagtgtgaagattatatagtaaagatgcatggacatttgcttttcattccattgtatgtcaatgtctgatacaatagaaaaatgttttaagttcgttttcagaaagcaaaagtgtcagcccaggaagggcaattcctgatggctataaggagcctctgaaagactctcaggtggccccagctgtgtgctcattccagaaagagagctttaggccctgaggccccccgagtccctaagcttttgaaattgtttgcctttgacctttgtcctgtgagaagttactggaagagcaagagcagcagctccaggccctggcagcccattctaggcgggagcttttgacaaattaccacgttgatgccttcttcacgcacctgtaaggccaaggcattattggccaaggcaatcgatatatcaaaatgaatttttggaagagtgtcatcaagctcagctttatttccaaaacaaactctgccccagggagggaaaaatgactttcactgtgaagtaaacagttgattgtttagacattacttatgtcatgctagtccatctgagatgtaggcaccatggtaaccaattgtccccagaattcatatttttgaggcccattaaaactcgaggctgctggagtcatgttctccgcattttggccattttaataataataatgagaacgttaaaatgacatttggaatttatatcacacttgtctgtgaggtgctctcagcactttacaatgtatcatccatcctcatcacagagatgggaaatatcagaggtgggtagtatttgtgattatattcagcttagtaaagagccccccggcttgaaggaatttcagtgatgtggcatggtgcttgccgacttgtggggacagaagaggctggtgctggcttggtgcttctgctcggtccatctctctctgcctcagtttccatcaatcaaatcagataacagcagtgtgtctcctcatcccgcagcgtggttatgtggatcattgtattaatcatattaactaacgttttaaaaaatttacttgctatgtgccaggtgttctaagatctttttgtatgctcattcattgaattctcccaaggccctatgaggcaggtgcagttaattatcctattttagagataagcaaattgaaacacggagagtttaaggaacttgcctcaggtaacacagcaattaagaacctgaggtgtatctgacccaggcaggttggctacagagcttgcagtattaaccactgtgttagagttgcttaaactttgatatagcaagacaatacacacacatgcacaagtgcacacacccgcacaggcagagcaaacaaaagtttcactgaacgatattcacccatccttacctttgaatgtgaagtgcattttgatcttttctcttctattcatttcattaacgaaaatgccaatctgaagccagtaaactgagtttatgatcatgagtaagtctgacatacattttgaaagccttagcactacaccatactccttcatagatgctcctggggaagcatttgagaagagacatgcagggagtgtgtgtgattggctggggagggtcgtggagaccagaatgtgtgaagtgtaggccctggctctgctcccacggtgctacctcctgaggcagctgctccgtgtcatgtctgggcctgtgggttggcgggcagaggctgccccactctcctcttctactttgtgtcataatagtctttgggggtcttctctgccagcctccatgggcttcagctctgagttaaccccaggtatttactgaatagacattatgtactgggcctcgtaggtatccagctctgactgggaggctacagagaggcattagacatgttccttgactgcaaggaaattgcaagacaccagggaaggaaggctgacatgtcaagggagaattaggggcaggtcccccagtgctgtatgtagggagcatagattttggagctagatggctcctcctagtaatgtgacctcgggcaacatacttgacctctgagagcctaactctggggctgcacctgcagcctgagtgatattatcctggctagtgaaactgtttggtgaaccatgaagtgttactaagaggttagtatttagaggtcatgttgtcataacagtattgccaaaagtctggcaacagccataaacattggggtttcagggaagggacggagtgttgcagcaatcctggaagccttcctggaggaggcagcatttaatctgaagcaggtattttcagttcctgactggaaggatcatgggtcacttagagatggaaacagatacgcaaggtccaaccattcatgtagaaaccatgcttatatataattaggtcatagctctgactccaataggaggatcctgagtgctttcataagttgttggggttttgttgttgttgttgtttgtttttagagacaagatcttgctatgttgcccaggctggccttgaactcctgggctcaagtgatcctcctgtcttagcttcccaagtagctgagactgcaggctcaagtcactcagtacactgctttcctaagtttgacatgccctgctggcttgaggtcactggcagacaaccacttgattcccttaggtcaggggttagcaaattacgtatgggcaatccctgtttctatatagctcatgatacctgtaatgtcagcaagctttttttttttttttttttttttttacatttttttgagtgttgtagaaaaaaaaatatgcgacagtactatgtggtcccataaaacctaaaatatttactatctggccctttaaagaaaaaaatttaccaactgatgccttaagtctcaaagtatacaatccttgtttcaagttgaaggtcttccttagttctgcatcatcctttagtcattctccaggcccttctgtcataccctgagggtacacagggcccaagccctggagagaaggggaaagtaggcctccattagtcatttcctggcttccatggctgtcggaattcccctgctctgccatggcagcatattaatatgtcgcagcgagcatgtgtatgtttaattctgatgacatgtggcgcataagtgattagtggcaaatgccaaaatgctaggctggagccctgatgctattcataataacattcataagagtattcccccaggatgcagctttctgtttctccaacataaatagcttgggaggccaaatcacaaacacgatttctcttcatgctccacctggccattcgtaacaagcattagatgtgaaatttgatttaaagcagcagttaaactcggaaaatcacaatggtgtcaagcccattgtttattttaaagatcaagagaaaaccaaaggtgagcaactaattctttattttattttatttttttgtggtaacagtgtcttgatgacaggctaatgtgcagctcaaaataaaggtacctgggtagaaataacccctcaaacatcattgaggcaatatgccaagaggcgcttggtaaatggctgtgaaggaggacagattatcctgttgaaaggctgctgagatgcggctccacttgacaatggtgggacttttgtcacaggaaaattagatgcctttggataggtctgagattgttcttatcttttccatatagcaaaaagctaccactcagaaagaaaacagagagttgaaggagtaccctgattgaatgccttccagaaaaaggattgttttgagagaaacactttaatttgcttcagatgattctgtggaggcttattgctgaagtggttccatttcagcacaggtttagctggctctgaagagagaagtgatttttaaaaatcttagggaatacaaagcatttatccattaacctgagtcaccaaccagttttcacaacaaggcagcctaggagctagtggtggccaggatatgttttgtttgtttggctcagtgtttgctgcttgttttttaaagaatttgaacaccgctggactgcttgtgctgtctccagtttctcacagcatgcccacttcctatggggctgctccaggctgcctcccatatttgtctacaaagggattggagtccaaggtgcattgttacagcttgtgggttccatcgaaacatgacacctagttattcccatcctactttgtatcttgtgaccacagaaccctcctaacaaaggtttgtggatggtaggtgactccctgaagctcagccctagtcctagagaaatattacagagtccccctgtgctgatggtaggtcacggaccctagccatctccaaaggacagagtccttttcttgctagtgcccctactgatagaaatgttgaacaaagggccagtggccgttttctagcagtggttaattgcagtgagttctattgtggcagaaaggtttgaaaaccatctctcgcctgccctcacaataacctgaattgtggttcttggttagactagggcaaaggggtggtgacatgagaacacgaaccctggagctggactgctgggttccaatcccagttccctttttgctccttcctaggggtgtgaactgagatgcaggggcagctttttaggggaaggatgtataagttgggtgacagattgatgcaggaaagaggaagaacaattggaaatggctttgacattagtttgaattccaaaagtgggcaagtaaataccaacgcggtgcttggattaatgagagggtggaaatggaaagggatccactagttaacaaagtttaacaaccactgacatcagggtcagtgtggaaggaaggaactcatggcgtgctcagccaaagtactttagagaatgtcctagtttgaaactttttcagtcactgagatttaaaataataataataataatggcaaaattgtcatgaaaaaaagtcaaaagaggctaaagtggctcagttgcaacaagacccaggaaggatatgagaggcacatgtgcccttgcagggcgtgactttccacaaccggtgtgtgtggtgggggtgctcagagcagtcctgccccacattccctccagcctacttgcctttgtctgcctgaaggacacgctcttctctgctgtttgtctatgtgggtaaaggtctcagccaagagaaatttttaagtaaattaaaaactcaagcaggctgatccatagccatgctcataagaagcctgcctcaagtgactgtttattttctttattccttgatttttttcacaaataagtatagttacatgcctgttatatgccagcctctgttctgggcccaaagtgagggtaacatcttcaacccctgtgtgctcccagaacaggaaatgagatgcatatacaaacaagtgggatgcagagccctgggagggatcatggtcagggcagacagttccctgtttacagatacgctgcatttcaaaagttagctttcaaactcttggttaagaatctggattcattttccagtacagactttcttttcatgcatatatgcttttttttttgttgttgttgttgttgcagatagcaaatgtttattgaatgcctaccatggaaagaactgaaaataccaggaagataaaactttgaatccccttcaagtcagggagtcatctatacttaacaaaccagcaaaatgaaatgctgggcttggtgctgtgtgtgggaagtggcaatggaagggccccaggcagggccctaatgaatggagtgattaatacacttgacttctttttctttttcttccccttctctatcacaccgaagcttccatttcttccatttagctgttatgctaggtgctaggaggaaagcaatagtttaaactaatttaagtttagatgtgactagaactgatgggagattgtcaataacctctgaggggaaactttctgtgtcttaatgatctaagactcaggcttggggttttatatgactgaaagtcacaaaataccttaatccgctcttcacgcagaggggagatcttgccgtgtgcttgcactcacacccatgaatttcacctgcttctggagatgattttgctccagttcctatggtgtgtgttcccagggtgtttctccttgaaaatgcagttttttttcttcattctttgctttgggacttcaggttctaaagtcagtgtcaaggcaaaaaagcctgtagagtcacaattgtccttgaaaatcacttagcaagggattacattggagacccaattttaccctgtctcagtgagtaccacccaaccactttttccttccctcttagaaaaagggacgtgattgttcagttggaaagcaggagaggtagttgggtccaagaaatagaaaaacacaaatcgtgaaacaaacatttcactcagagtggtgactgatcactcccttagaagcatgaggtcgttgcaacaaacccatgtagacaactgtagatgcccaggtctcatctcaaatttgctgcctgccttagagacatgggattctgcagttgagtccttatggctgggcgtgggggtggaggggggctcctttcctgtaaagagcacacagatgctctaaatgtccgctccctgaccgccattaacaccgctcaggccccagggaaatgctttccttcatctctggtcctgcgtccttgaaacagaaggtgggcctgtctgattgccaggaaggcttttggctcatgcccctgtgaaaggcagagtcagacacagctttggacttcagagaagatttaagcagcaaaactgcttaggtaagaagagaaaacaaatgaattaccttgtcggaggcttcctctcacatatcagcgatgcaatagattcatgtataatgaactgtggtttcacagcagtactgagtgcccatttccttgctgcttttttttcttacaatttgtggtttcggagatattcacagattcccaacacttgcacatggtgactgaggaacattttttcaacattaaaaaatttatatcgctcttcactctgcatatttaggcaatattgattctttgcattggcaactggagaggcatggactgctataattaggaatactcttattttttaaatggttaataagatttaatttacattaaaatgaataaaaattagctttaaatatctctgatataaatagttggaatatattcagtatagttaatattttatgttttaattttcatttacattttaaaatttaatgtaatttgaattttttattacaaatgttcaaattttatacattgaatacaatcacattttattttagaataaacattatattaaaactattgatttgaataacattagcaattttgctgaaatgaaagcaaggaaagttagttttgtgaaacaaatatataataacttatgaattatttatgcttttattgcgtaactcatccaatattactaaagtacagatggtacctgacttacgatggagtgacttatgatattttgatgttaggatgacataaaagcgatacacattcgggagaaagcactctgtgagtacccatacaaccattctttttttcactttcagttcagtattcaataaattacatgagatattcaacactttcctagaaaataggctttgtgttagatgattttgcccaaccgtaggctaatataagcgttctgagcacatttaaggtaagctaggctgagctatgatgtgggttaggtgtattaaatgtgttttcaacttatgttattttcaatgtatgatgaatttatcgggatgtaggcccacagtaagttgaggaatatctgaattaacagaacacccagacatgtacaatgattagtcaatttgctgatctttggtattttgtgactttcagtcatataaaaccctaactttaaacatatttttaaaattttgtcagccaggcacagtggctcaagcctgtaatcccagcactttgagaggccaaggagggtgaatctcttgagcccaggtgttcgagaccaacctgggcaacatagggaaaccctgtctctatcacaaaaatacaaaacctatctaggtttggtggtggcatgcacctgtagtcctagctacttgggaggctgaggtgggaggatcgcttgagcctgggaggtggaggttgcagtgagccatgattgccccactgcactccagcctaggcaatagagtgagaccctctctcaaaaaaatggtcattatgaaggtgtatttgtcagggaaggaggatagaacactttattgaacaattcatcagcttggtttgtaactttaaaatatttatgtggccttccatttgtattctcatactgactacaagtcagaattacccgaactattgaactgttacctagtctcactagcatatagttgaattctataaattactagtctatggcattatgggaatttttttttttaaagacagggtctcactcttgtcaccttaggctgtgcagtggtacaatcatagctcatagtcgcctcaactcttgggctcaagccgtcttcccacctcagtctcccaagtagctgggaatgcaggcacacgcccatacccagttgacttttattttttgtagagatggggttctcactatgttgtgtaggctgattttgaactcctgacctcaagcagtcttcctgcctcagcctcccacagtgttaagattacaggcgtgagctaccacaccggctatgagattttattctaacactgtgatttaattaggcttctgaactcatgcatctgctggagtctggcagtgtttggccgcttcatttaaaaacttgatgctaatggccaggtaattgtttcaaagatcaccattgatgaagtgtccagatctatcagccacaaatgctgtgaaggagagaatggctatcttccatttcctttgggtttgctgtacttttagttcagagtagcagtggcccttcaaggtttgaaaaagctgaaaacatcagagaggatgcagtggacaaatattgagtcagtccttattaaagaaaagaaatttttgagtgggcgacatatcccaaaaggtaccagtttcctaagagccagataagataagaacacagataagatctgtgtacagatcttaggtttatcaaatggcttcagctcccctaccgcccatccattccctttatttaaattgggtgtcaatgtgatagtttttaaaaaattatagaataatcatttaaaaatcattcatgactcatcatcctaacacacctgtttttattgttacatgttaacttactcgtacatgtaaactactgcattgttccaatcagcatccatatgttattctgattttttgttttaaatgttacattgtatatttttctatgttcccatagtccttataattcccattttagagtctatataatatgatgacatgattttacatgcctttttttgtaacatggaaatttgagaacaaaagaagaaactgattcatatccctagatcctttgagtttttattagtcttatcactctttaaaacccctactgacttatttccatgatgcaagcaagataatttgttaatcaaaagtttaattaacacacatactagagttacatatttattttaggccaaattttaaaatgtaatagacttaaccttgatatatggcacccccatgtaattgatgtatataggacatttatgcctgttttctaggtcttttctttcattgctttataaggctttaaaaatgtatacagggatttattgttgtgtcttcgcttctatgacaaattgtttgccatacctgtgatttatttttcactaatttgttcccagagaacaaccttgaaatgtagctctccaatacaatgctgaccctatgaggaaatgatgatctgccttctagaaacacattagggtaaacagtagacactgctggtatttgcaccaagtaccagtcaagggcaggcccctgtatgaataagaggcgaaggtcagtggtcaccagcgggctcaggaggagacaggggcttgtctggcatagcccactatcatgggcatttcgtcagtcacagagatcagcacaggagacctcgcaggagaaatggcaagccagaagcgggggtgtgttttgaggaagggggtgaagtgcagagatgtgactcctcagagaagcatgtgggcaagtcttgaaataacagagaaagaactagttagtagattaaagcagattttcaaattacatttaaaaaattctcttaattggcatagagatctctagaccagggcaatctacatttttattgagactctatactgagtgcccagcatggcaatagcgtactgcactcacccttttattcacccattaatagtgagcacccactatgtgccaggcatgtgctgggcctcagagacacaaagccatgaagaaatggtctccaccttccattttcttctggtgtaatgagaaagacagacacgcacataaaccagatgttgcaattcagagcaaaaagtcttaaaacagtgttagggccaagtgccttggaagcattcatttattcagtaagcgtttattgagtttctgttgtgcaccaggcattgtgctaggtgctggacatgtaggagagaacaaagagggtaaaactcctagcattgtggaattgacagcttggtgacgctagaattcctcttagagaaagaattttgtgcctctgcctgtgtcttggaaagcttcctggagatgctggcaaggctaagtttacagggcagtaggaatgaggaagtggaaatgaaggtgggataggggcagcaaaggagtatgggagagatagaggtggagcaggggcagtaatggagatgagatgggagcagaaatggaatggagtggagtagagagcagggatggggctgcaatgagggtagggtggagatagggtagattgtggggacagggatgaaggtgaggtggacaggcagatctttttctagtatgcagagacaagtgtgcaatggcacagaaaagtgaagcaacatggttagggcctgaatatatgccccatatgtaaagatccagatgacccagccaggtcccaaggggcatgtaatagtgttgggcagacaaggtgaatgcatgaaacgggcaaagcaatgccccacctggtcaagagagctgctgaattttgcacctttggttgtaaattgctcattagcagaatctgagtagcgggcctgttgcagtaaccgccagcctggtctctgtacctcggtcttcatccctgtcctatcccttctgtcattcattaaatatttactaacacctcctaagtcctgggcccagtagattctgttcatatatagttaatttaaagacaaagtctgtctccagagcctaggagctattagataagtttgtacaatcccaaggagttaagagctttctcaggaatagaaaccaaatctaagtggaatgtaaagaggagctggctaatattatcaggggcgctttgttgctgacatttcgttacaattttctgaatgcttcatgtattttccttcattcttaactgacatttttgctgaagcttgcttctcaccctcttgcttagagatatcttcagctgctaggctcaccgtggtccaggtccacaaatctctcaaatttgtattataactattataacaattaactgaacatgtgtattgggtgcctgctcagactgaaaactgcttaaggacaggagacttcttttggagccttaactaagaacattacaggtgttccaaaaatatttgttttttagcaaaattggagcaattagaaaagaatccattaagtttagcaactgaagcaattagagaataattcatttttaaaaactttagaatatcagagttaaagtgtatggcttggctttttgataaagctattgacctttggattccttttgtcaaattctgactctccaaatatcaccagcacacaaccagttgaggagagaaaactgaatttattgtttgctgcagtaaggaagaaaaccaccttgacagctttggtggtgtcttggaacagggcaaagcatggttggaatttgttgagaagtggaagtttgatttaaggcagacctagatctttcaatggggaggacttgattagaatgggtaaggatcatgatagaaaagtttagaattggtggaaatagcaaggtaaggatttttgaggcagaagacttaaagaattttagggaataaactgctcttgatgaattctttttatgagagttctttgggtcctttgagaagttcctataatgaacagtcaaattatctgcctggacaagactctcctggcatactaagatggtgctagtgatgacaatgaaatagtaaagtcatgtatgtagacagtaagctgtgtggggtgtggatagttttggttctcacttgctagccaagcaggaagtaattgatggctagaaaacaaaacacaaaaggctttctctaacgttttgtttgggagtttgaattttcacttaggcacatgcagaggcaaagaggtctcctgtccatggaaatgtgtttcatggataagaagaggtcagtcgtcaggttactgggtgctgacccctgggatttgtcaaacacacgtcagcggctggcttccttaacggctttcttaacagctgatgccgagtgctgcctgcaatgatgcagtgagtttccatgttcccttgtttctgtgtcacatctttctcttgacatttatccttctatgagatgtttactaatgcagagacccaccagatgaaaatgtccaataacatcatgatactttatttcatattttattgggtcagaaaactgcaatgtctcttccatttcatgctgactgccaccaactcacttctaagtatactgtaagaatcatgcctttctttaatcatgcggcaaaatctcacccaaggaatctgaaattggtttttctccccttctgtccagacactgcagccccagacatctttttggtacctttctgagtaaaatgggaggacaatggtgtgatgcagatttcagcaataaataattttgtctcttacagccagctctccgcaaccccctgcaggctgtttgcaaactgcagtttttcaaataccaccttgcatggtattaaaccctcttgagctgagcattggagaatagtcaaaataagctattgagttctgggtgatagcaggtgggcagaaactgaagccagagctgccattgccacacggcaaggtttctgcaaatcgccttcctccccaacagagaatttgactctggtgctttcttttctttttcctttccttcgtgtttttttgtttgtttgtttgttttgttttgttttgagacagagtctcgctctgtcacgcaggctggagtacaatggcgcgatcttggctcactgcaacctccgcctcaaggttcaagggattctccagcctcagcctcctgaatagctgggagtacaggcatgcgccaccatgcctggctaatttttgtatttttagtagagacagggtttcaccgtgttgtggtcaggctagtcttgaactcctgacctcgtgatccgcctgcctcagcctcccaaagtgctgggattacagacatgagccaccgtgcctggcctagtgcttactttattaatggaagctgtttgaattttcatttggttgtcttgggtttgagggcttctcatcagcccttttttattgtttcacttttcaaaaacattccactttgcttctcatcatctttgttcctcagttgaactgagagcaagtgtgattttaatgaagcactgatccttttttttaagagcttttcagcaggcctagatgattggcatttattatcattttgtgtctgccttctgctcagaatataaaggaatcttggaattattttctctcttctcttataggcccaaaggggtctcacttctctcccccttccttgctttttaaaattttacatctcctacaccttctagcatcccctggtacaatctcctacaggcccttcaaaatcttttgggcacaagtggctgggctgagtcagacagcttggaaatgcaaaaaggcaggccaggcagaaagattgatggtggaatgtcagcttgctgccagtgtctgtaccatgtggaaccatcagggtttcccttgccctttgtctgttccaatatactttgcttatcacccaggctctggcaggtcaaggaagacctgacgtggcagcttctagggctgagatttgcatgaaagtgctggaatcaaaactacctgactgatgtctgcatggagctcataggtccctaggttgtaactgtacctgctagggccaccactgctgatcagcatagaattgatgcaaagcagatggccaccaacattgagctttctgctcagctcctctcctggctgtgcttcatagaatgcaaaggtaagtgggctttccactggcacctactttgtaatggacatttgattataggcacttggctgagaggcctgtacattttttaacatatttaccttctgacttttcatttcttatctgcatatggttgttacctacacctgggattcgtaaaagttcatcaggaaagcacatgtaaggtaccagaaacagtgccaggcacagggcagcctctctatagctgtttattcctttctttcctgcttccttcacctataccctctgacacctcagccaggctgctggttgctagtaggtgccaagggaatggtgctgaagtgagtgccctcagagaagagacaagaaagctttctgagtggggtttgaacttcttccctctactctgccagccaactgagctaacagaagttcagcaacagctcaccatttcctttgaatcggtgtctccaattctcagtcttcaaatagctccagcagacagcagggttttgtttttcctttatttagaaccaattatggtctggaaccaatttggtgaaaggtgcctgagttttccttagcaacctaattctgtttgccttatgtgcttgacttttgctgattttcagcccaaattccagctatgtccagtgctcaaaggtggatgccagaggaaaagggctggtgggatcaacctgccccaggtgcttgaacagaaatgctctgggaagaggtagaggggatgctattttttagcatggggctgtgggaagctctggaggctagctgagagccattgctatctttgaggctgtgtgtgtgtgtgtgtgtgtgtgtgtgcacgcgcgtgaaatgctttgccctttgatagtcacaagggtcacccattctttcattctgtcctctgataccttctcaccgccactctcccattactctctatttccactctgctttattgttcatcatagtactcacctctacttggcattatgttgtacagttatttgtttataacgtgtctttccaattaaatgtaagctctttgaaggcagagtcttgcccatgttgctcattgctctattctcagtgccttgagccatacccagtgcatattaggcactcaataaatattcattgaatgaatggatgagtggataggtaaatgtctttggtgtttgggacaccaagcagcaaggtgagaggttattatatgacatgggcttgacaacaggctacatagggaggaaacctggcagattaatgttcttttagtcttttctttctttccttcccttgcctctcatcctctactctatttcacttgttttactatattcttaggatttacctttgggctgttaaataaatttatttaccagtttctaatgatatcttttgacttcttagctatagaagataatacagtagcttcttccttccccttctgttagttatattagatctacattttcagggtttataatatttacctgtttttaatcataaatcccaacttgctttagtcttagtcctacatttaaatagattcagtcttcttcactaggcctttgctgttgttttccattcaactcttgggtggctgaaaacttcttcccctaatagtttcttcaagacataacaaaatgtcttgaattgttgtaagttcaaatatggttcatttcttttataatgaatgatagtttttgctgggtataaaatttttgagtcacactgttttttggaggactagtaccaaaggtatcactccactatcttctaatggtaaatgatacaatggtaaagtctgaggccaatctcatttttccccatcataaggaaggagtgactgcctgcccaaatattctttctttatctttggagtctcataaatgtactagattatggttgtcacttttttccaggatactctgtgactttcaagatgtagtcaagtacaatgtattcaagtcttcttttatttctggaaaatgtattgagttacacctttaaatattcttttatgtcttttgctaatcttccttacctatcattttctttctaatccctttaaatttcttatttccatttcattctgttcttacttttttcaatcactgttctttcctttctgtttctttctgtatttttttaaattatactttaagttctagggtacatgtgcacagcatgcaggtttgatacataggtatacatgtgccatgttggtttgctgcaccaatcaactcatcatttacattaggtgtttctcctaatgctatccctcccccagtcccccaccccccaataggccccagtgtttgatgttccctgtcctgtgtccaagtgatctctttgttcaattcccacctatgagtgagaacatgcggtgtttgtttttctgtccttgtgatagttagcggagaatgacggtttccagcttcattcatgtccctgaaaaggacatgaactcattctttttttatggctgcatagtattccacgctgtatatatgccacattttcttaatccagttctattcattgatggatatttgtgttggttctaagtctttgctattgtaaatagtgctgcaataaacatacatgtgcatgtgtctttatggtagcatgctttataatcctttgggcttatacccagtaatgggattgctgggtcaaatggtaattctagttctacatccttgaggaatcaccacactgtcttctacaatggttgaagtaatttacactcccaccaacagtgtaaaagtgttcctatttctctacatcctctccagcatctgttgtttcctgactttttaatgattgacattctaactgatgtgagatggtatctcattgtggttttgatttgcatttctctgatgaccagtgatgatgagcattttttcatgtgtctgttggtggcatagatgtcttcttttgagaagtgtctgttcatatcctttgcctaattttgttggggttgtttgttttttacttgtaaatttgtttgagttttttgtagtgtttggatattagccttttgtcagatgagtagattgcaaaaattttttcccattctgtaggttgcctgttcactctgacagtagtttcttttgctgtgcagaagctctttagtttaattagatcccatttatctattttggcttttgttgccattgcttttggtgttttagtcatgaggtccttgcccatgcctatgtcctgaatgatattccctaggttttcttctagtgcttttaggttttaggtctaacatttaagtctttaatccatcttgaattaatttttgtataaggtgtaatgaagggatccagtttcagctttctgcatatggctagtcagttttcccagcaccatttattaaatagggatgccctttccccatttcttgtttttgtcaggttggtcaaagatcagatggttgtagatatttggtgttatttctgaggcctctcttctgtttcattggtctatatgtctgttttggtatcagcaccatgctgttttggttactgtagcctcgtagtatagtttaaagtcaggtagtgtgatgcctccagctttgttcctttggcttaggattgtcctggcaatgtgggctcttttttggttccatatgaactttaaagtagttttttccaattctgtgaagaaagtaataggtagcttgatgcagatggcattgaatctataaattactttgggcagtatggccattttcatgatattgattcttcctatccatgatcatggaatgttcttccatttgtttgtgtcctcttttattttgttgagctgtgctttgtagttctccttgaagaggtccttcacatcccttgtaaattgaattcctaggtattttattctctttgtagcaattgtgaatgggagttcactcattatttggctctctgtttgtctgttaatggtgtataggaatgcttgtgatttttgcacattgattttgtatcctgagactttgcttaagttgcttatcagattaaggagattttgggctgagatgatggggttttctaaatatacaatcaggtaatctgcaaacaggaacaatttgacttcctcatttcctaattgaataccctttatttctttctcttgcctgattgccctggccagaacgtccaacactatgttgaataggagtggtgagagagggcatccttgtcttgtgccagttttcaaagggaatacttccagtttttacccattcagtatgatattggttgtgggtttgtcataaatagctcttattattttgagatacgttccatcaatacctagtttattgagagtttttagcatgatgggttgttgaattttgtcaaaggccttttctgcatctattgagataatcatgtggtttttgtcattggttctgtttatgtatggattatgtttattgatttgcatgtgtcgaaccagccttgcatcccagggatgaagccgacttgatcatggtagataagatttttgatgtgctgctggatttggtttgccagtattatattgaggatttttgcgttgatgttcatcagggatattggtctaaaattctctttttttgttgtgtctctgccagcctttggtatcaggatgatgttggcctcataaaatgaattagggaggattctctctttttctattgattggaatagtttcagaaggaatggtaccagttcctccttgtacctctggtagaattcggctgtgaacctgtctggtcctggacttttttgtgttggtaggctattaattattgcctcaatttcagaacctgtaattggtcttttcagagattcgacttcttcctggtttagtcttgggagggtgtatgtgtccaggaatttatccatttcttctagattttctagtttatttgcatagaggtgtttatagtattctctgatggtagtttgtatttctgtgggattggtggtgatagcccctttatgattttttattgtgtctatttgattcttctctcttttcttctttattagtcttgctagtggtctatcaattttgttgatcttttcaaaacaccagctcctggagtcattgaattttgaagggttttttgtttctctatctctttcagttctgctctgatcttagttatttcttgccttctgctaacttttgaatgtgtttgctcttgcttctctagttcttttaattgtgatgttagggtgtcaattttcgatctttcctgctttctcttgtgggcatttagtgctataaatttccctctacacactgctttaaatgtgtcccagagattctggtatgttgtgtctttgttctcattggtttcgaagagcatctttatttctgcgttcattttgttatgtacccagtagtcattcaggagcaggttgttcagtttccatgtagttgtgcggttttgagtgagtttcttaatcctgggttctaatttgattgcactggggtctgagacagtttgttgtgatttctcttgttttacatttgctgaggagtgctttacttacaattatgttgtcagttttaggataagtgtgatgtggtgctgagaagaatgtatattctgtttatttggggtggagaattctgtagatgtctatgaggtctgcttgttgcagatctgagttcaagtcctggatatccttgttaaccttctgtctcattgatctgtctaatattgacagtggggtgttaaagtctccaattattgtatgggagtctaagtctctttgtaggtctctaaggccttgctttatggatctgggtgctcctgtattgggtggatatatatttaggatagttatctcttcttgttgaattgatccctttaccattatgtaatggccttctttgtctcttttgatctttgttggtttaaagtctgttttatcagagattaggattgcaacccctgctttttttttttttttccatttgcttggtagatcttcctccatccctttattttgagactatgtgcatctttgcacatgagatgggtctcctgaatacagcacactgatgggtcttgactctttatccaatttaccagtgtgtgtcttttaattggggcatttggcccatttacatttaagggtaatactgttatgtgtgaatctgatcatgtcattatgatgtttgctgtttattttgcccgttcattgatgcagtttcttcatagcatcgatggtcttttcaatttggcatgtttttgcagtggctggtaccagttgtttctttccatgtttagtgcttccttcaggagctcttgtaagtcaggccttgtggtgacaacatctctcagcatttgcttgtctgtaaaggattttatttctccttcacttatgaagcttagtttggctggatatgaaattctgggttgaaaattcttttctttaagcatgttgaatattggctcctactctcttctggcttgtagggtttctgccgagagatccgctgttagtctgatgggcttccctttgtggataacttgacgtttctctctggctgcccttaacactttttctttcatttcaaccttagtgaatctgacaattatgtgtcttggggtggctctcctcgaggagtatctttgttgtattctttatatttcctgaattggaatgctggcctgccttgctaggttggagaagttctcctggataatatcctgaagagtgttttccaacttggttccattcttcccatcactttaagggacacaaatcaaatgtagatttgatcttttcacatagtcccatatttcttggaggttttgttcatttcttcttactcttttttctctaaccttgtcttctcactttatttcattaatttgatcttcaatcactgaaacccttacttccacttgatggaatcagctattgaagcttatgcgtgcatcatgaagttctcgtgctatgattttcagctccatcagttcatttaaggtcttctctacactgtttattcgagttaaccatcgtctaatctttttttaaggtttttagcttccttgcgatgggttcgaatgtcctcctttagcttggagaagtttgttattaccgaccttctgaagcctacttctgttaactcatcaaagtcattctctgtccagctttgttccattgctgtccatatgtggtgtcagtcagcccctactgggaggtgtctcccagttaggctacacggggttcagggacccacttgaggaggcagtctgtctgttctcagagctcaaacgtcgtgctgggagaaccactgctctcttcagagctgtcagacagggacgtttaagtctgcagaagttgtctgctgccttttcttcagctatgttttgcccacagaggtggagtctagaggcagtaggccttgttgagctgtggtgggctccgcccagtttgagcttcccagccactttgtttagttactcaagccccagcagtggtggacacccctcccctagccaggctgccacctcacagttcgatcttggactgctgcgctagcagtgagcaaggctccgtgggtgtgggacctgctgagccaggcatgggaaagaatctccttgtctgccagttgctaagaccttgggaaaagcacagtatttgggtggaagtgtcctgtttttccaggtagtctgtcacggcttcccttggctaggaaagggaaatctcctgaccccttgcacatcctgggtgagacgatgccctgccctgcttcagctcaccctctgtgggctgcacccactgtccaaccagtcccaatgagatgaaccaggtacctcagttggaagtgcagaaatcacctgtcttctgcatcagtcatgctgggagctgcagactggagctgttcctatttggccatcttctgtattcttaccagtcttgttttacttgtgttgcttcaattttgcctttatttctataatgtttttattttttaaaaaaaattcacttatttccagatttttcttagctcatatttcaaattcttctatcttatcacattttccatgagctcatatatatctactttacctctctctctctctctctcggtgtgtttgtgtgtgtgtgtgtgtgtgtgtgtgtgtgtgtgtgtaagtgcttcattaagtttttcaaaaatcatgacaaagtatttagtcacattttttgtatctgctccatggcaatagttctctgctgaatgtttttttgtttgccattacttttcatatttctttgcttatttttcctataatattgctttatagagcctgtagtttttccttcttgatgacaaagttttgaattctttgaattttccccccaggccatttgtaggaaatttgtgtagggaagagaagagaaccacattgcattcaaggaaaaatttttcttcactgcagtgttttgtatgaatccttttagccttcacctctgtccagtcaataaagatgagcaattatagagctgttcacaatgccaaatctctctcctccccaactcatgtgggaagactttttttctgcatatatgacatatctgtgtgtctccttattcaacccattttcacctgtttctcagaatacagctggttccaaagagacattgttgactgcattttagagcccatttccattgttgaaagtaagggattctgattctacacctctgggttgctcctcactttacagtgtacctttttcactccttcctaaaacagcaaccaaagaatatcctctctctgtttctgggctctgctatttttggtgtcctctctatttacttcatgttttacagttccatgtctcctaggttcatcacaggtagaatttgtgtttgtgtctcttgtttagagttattgttaaaaagggaagattgaatgttagtcatgtgctaccatatccaggtgggaaaacctcagccctttttgagaaatctctttcttcattaatagaaagcctgttttccaactctcctgattctccaggaagcagctgttttcttttctcgttctctccctctccaggtttccaagtgaggccagattccttgttcctcaaaaggctttaccctgaccacccatgcctgaatcctcattgtgctcagattccacactgggtgtagcttctactgctttgattgcaccacctttttgtatgtgtatattcctttttgtctaaataatagggcatttagggacatggtctggggcagaaacactctgtatcctctctgctactagcatgtcactccatgttgtaggtgctgcatacatgatcatgaattattcccttctagggaattcttattgaattagatagctgtgtacttggcatgcattatatttgacacatactcagtcacgaagacttgataatgcatagactgcttctgataaagaactgtgggtaagtgccctcttgaacttatatgacactgagcaatgtcattagaaataacttcagcttttagttgtctccaggattacgtagatcagtgatccttccaaaacgatacctgctagttacagcctttgggatcaaatcacaatgttcctggtagcctgcatcctgcatactttagtcatgttccagagtatcagacctaaaagtaaaaggagctaatgaggccagtgactctcacagggtttcccactgcttcctaagtagaagcattttaaaatttgggattttagggtaaatggtttgaaaaacaaacaaatgaaaaacctgcataggattctagtataacttcctagcaatatgtctcctcatctctacccttgctcccagactcctaaagatccctggtttagtccgatgcctgtgttttagctgtagaaagctggcacagaggggcacagtaactcatttaaggtcatacatcctatgcatttttcctgaatggctgtaccatttttgcccttcatgtagtccacagatggacaatttcttgatagatgaatctgatgtgtctgaaagttggcttatgctaaagttaggcttgatgtctgggctgggggagaggggagaagatgctgttgtagaaaaaaaggagtcattggagtagaatggaaaatgtacatttgacaccaatcaataagccaatgcttaaactgagatttccaaacatgataaaggggtggaaaagataaaatagtaattcaaaccatagcagcctccttgaccccagtcagtaggagactcagtggaacaaatggttgcttttccaaattaaaaaagaaaaaaaggtggcagaggttaatttccagtttctgggaaggtgtgcttaaaacatgatggatttgaagactctgccaacaatttctctgtctctgtcttttttttttccttacctttaactttcctgtttctgaaattctagtcatttttatttcattcagtatcaataaggtgcctacatggtaaccccagatgggaaagagatgcataaccccagagcacagccagctctgggcaggggcttgctcggggttgggctttgggtgtatgggtcagcaaagccgagagcaggctgccagggacatcctggaactcgttggcacagcccaggattttacatacttggcaagggagtggactgagaaggatagaggggtgtaacctgtgctgggtttggagatagggaactgggatgtatgagtaacttggaggatgtggactgacccttccaaggaaattccaaagccatctggctcccttggtaatgcttgccctagaataatcgtataagacccttgtgggtagtattctcattctgcagataaggaaaatgggatgctaataaatgaaatgacatccttgtgttacaaaagtcactctaaacaagtctcagtctacagccctcgactctgggctcttacctcacaactctctctactctatcacagagctggctttttctctgtgttaccaccggcagttttttcctagacttgctagctgcctagtatcgtgctcaaggtactgccatgtatacagtagttacaacattaattccagctgaagaggagcttattttaaaatattattgaatgtattttcaattttgaaagtaatataccaaaattcagaacatttagaaaaccataagatcaagaaacatttaaaataatctcaggctgctaacacaacagctgtaatcattttggtctgtgggtttttggtcattttcctcatacatttagcatttggaaaaatctgttgaaaaccatattgcacatacaatttcatttcttgctgttttcatatagctttttgtcgtaaatcccccatcacaactttaatggcaggagaatatttgtgaggagcttaatcatgaagcatttactaatcatagtattaaagcatttgattatattagttcaataagtatctgtcaagcaccttgtgcccaggctctcctggcagccattgccccagtgacagtcaccttgctgtgccgagggatttggaatactcagaaccacatgagtcagagccccacacacattagtgagaaccccccatatgttaatggaagccccagactttcattctggctcttcttccatcagtgggccatattcaggctggctgaggccaagatgcaacgcagtaagattaccatgggcccgtctaacattttctttataaattcatctccatgactgttttaatcacctcttattagccctgctcatgagggagggactcctggcctaggtttctggagatagccaaatatataatacccaacactggacagatgagatgtacagcagtttattaagtcacatttgctcacagcccagggaggacaccatgttgcatgcagggcctcacaaaggttgcactcaggaacagagtagaccaccagaggccacggacagcaggccttgtagtatcaagaggttgtggtgctccctgtttcttgtgaaaggatatgattggcttgtttgaataattttgcaggctggcacagaactgaaacctacttctcaggggtaaactgtaactgtgcctggtccctttgataagaagggttgttgggctaggggaccttatctaagggggcagagtagggaggggaagtggctgttaggccattcaaggccctcctgattttaccagatgtcaaggcagcacctaataatgaggcttaatgttacatcttacaccacaatgacaagaactgcttttcctgcctccattttctacagctctttcctcctacattttttttaaacactctggcctttgctgacttttctttgtgcagctgtctaatagtatagagtttaaagtcagccaaccaggcagtccaggctcagccacacactagcctgatggcattagacaaatcacttcacctctctctgccttggtttcctcatttgtgaaatggagatgatggtactaaaagtccttacctcacacagtttttgtgagaactaaataatacagataaagcatttagaatagcatctatatatgctatgtaggtacaaatattcctatttttacttataagtttataataataatgtgattctgctcttttcagcctttctactccctttctccaaggtaaacttaccacaagcatgtttccagaaaatgtactctgttcattcattcatgtatttcttcatttgttcatccattcagtcaacaaatatttaagatcctctgtcgtgcaccaggcactgttctaggtggcagaatccatcagacaatgaaactgacaagcaccttaggagctggggcttagtgtgaaagtgggtagacagaagataggcaagtatataaactgaaaggtagttatgactggcaaagagtgctctgaaggaagaaaataaaatgaaaaggaagccatcagagagacagcttggtttccttatacaaggcactgagagaaagcagggctagggttctctggtattacaggggtggtgtgaggtctttggagggcaacaacctctgttctcttgcttggtgaaagatacaagattcattaagattgtcttcctaagagtcgggtctttttttttttttttggtcttctttaaggctcttccctccccacttccctggccatctctttcctcctgtcaagaaaggtcctatcttgttagcccagtttatgcatcgattttggtctagagtcagggaaattaatagggaaagacaggagaagagaggcaagaaaaaggagaaggacctgctgtgtgaagttaaactcagtttataaaataagaagctttacaggagtgcagagagaggttcaaggaaaacaagccccagtgttatttattagttatgtattgctatataacaaaccactccaaaatttggtagcttgaaacaacagtgatttattatttctcacaatcctgtgaattgacagttaatgtctctgctggttttgcttgggctcactcgttcaaccacgggatgggcaggactggaatatccgagatgggctcattcacttgtttgcaagttggtgcaggctgcaggcttggacattttgatgtcttcatcctctaggaggccagaccaacttcctgtaagcagcctcagggcagcattccaagatgatgaaggcagaaattgcaagacgtcttcagtcctaggttctgaaactcacacagtgtcacttctgccacattctattggtcacaggaagtcacaaagccagcccagattccagctggtgagatagatgttaaattaaaaatcacgtagttcttatttttgaagctgtgaaagggagctgaagaagaagtatcacatgagcttatccatgacgaacgacatgcccaacactgagccatcatctggattgatttacttccccttgcttgggatcatgcatatacagacatggctgttggtgttcagttgtgtggtaaaagtttaacatagcagccttgaagctggtgtccttagagaagctcgtgtgcaggattggcctatgacgggcatctgggaacttgaatctcaggaggatcccagtattccctaaggatagtgcagtatgcctagactatttgtacaaacaacctagtttattctgatcactcatttctagctaggaatctggaccattggtgcattttagacaaatggtatccatgagagaagcccacattaaaaaccttcagcactaagtctctcactagcttctcagggcagaaacatctcactcatgctgctgcagtttgttgctcagggaaaagtgggctgtatgtgagctctcaggggaaggagagagaataagcaagcttgtgcatggatttccccagacccagcctgtgtccttccctcctatgacccggcagtatatccttccaacattgctgcaataaattgtagtcaagagtacaactacatactgagtcccactagtccttctagcaaacctccaaatgtagaggtgctcttggagactctagcatattagtcttgttctcttacacgttttgtcttctatgaagatgggagccaattcccagggggcatggggcaataccagaaaattaccttgagggattttatgctaagaaggaaatgatgtcctgtgtcccttaaaccaagaggtcctagcaggcctggtggctgtaagccaatgtttcaaaatgatgatttgacttgcttattcacaaaatttgtttggatttgagacataattcatttaattagtagcaaacaggtggtaatttggaatatgtgaaagtgattggttctctctgaaacctcaaggaacagcatctttcactcaatgagaaggttaaaacaaaagcaaaaaaaaaagaaagaagtccctttgtcctgatcagatctgggcagtcgcctggacaaatctgtaaggatagattaccaggattgtctctacagaggagttccccttttccttgcttctaaaccaggtgtcgtccatcaaccagtcctctggagcccaggaactctggggcctgtaactacagtggagggaaagttagccatggaatgcaacttcccctagtctccctgtaccccctctccaaactatcatgctgctggtattggcaatgaaactgtctgtgagtgcattggcactgttgtacagtaagtaatcacagccattactgtttcctggggagtccctggatggcaaagagcatggtagccaataaggaggcaaagagcatggtagcctaggaggaggcatacacatctcccttggcaggtttacagtggagttgtcaaacatgctaaggttgtcacagcgtttgaaggagaactacttactgctttggaatgggaagagggttgcataaaacaaaaagtataggatttagaatttaacagaggtgggtttctttttttgcctaccacttaatagcttatatgacctcaggaaggttaattaacctctctgatccttaacatcacaaactcagagtggttgtgcaagtaaaatgaggtggtgtatataatgtatctgaactgttgcttagcataaaataactgcttcttaaacttgggtgatgaaaatatgatatatttttatttttgcttatatgtatagtattgatgaaattttctgtaatgaacaaatatttgttttataatgagaaaaaagaggattttttttaaaagcttaaagcctattttctttccttgccagccttgcaggctgtgtcttggctgagcctttctgagtcattcatgcttagcatactcttgagcttggctgtctctgagcagtcattgtacagtaacatccacaggggtttggaagggttcatgtcttaactgaatgactgaagaactgtttgtcactgacataggtaaagtacctcaaatattttctcaatatttcagtaattataatttgaattaatttttcatccagaatcattttctcttagcagagtcgctatcacaacatttaaaaagaaagagagaaagataaaacctatactttctggatgattgtcctttttttcaaatttgagtttccttgcgatttatcttttgtttcctttccagctaggaatgaaatgcatttttcaggaaaggtcagggtaggctccagcaaactttgtagctctggggaacattcccagggccagggttgactgagttctgtggtgtctgttgagaaaatctctggcaagtcaggcttctgggctgctcctctcctgcagggtaagtacaaagagggcagcataacccccaggctaacaggcctggacccttttgaggaaactaaacacataggcagagtgagctgagtgagaactcctactgtgtgcaaattagttgctgggtgtcctctggtcttttctttaagtctataacattttagatggagaatgacaggtagaaaatttcagggctgttttttttattgcaaatgtgtagaggaccaagagtggcatctgtgcccagagagcacttggcctctcaacaacttgagctagtacattctgacttgcattatgattactcttcagtatgcaggagctctccctcccacactagagtgtgaactgatttctcctgcgtgacaaggtcaccccataacttcatgttttatatttttttaacatttttaaagtacctgccaaaaaatggtgcttatatgtgtttgctaattgacagtaataccctagtaggagttgtaggcagtgaagaaatattaagcaacagccaatattataagaaattttcttggaccccttttggagtcaaagagaaccattacaatgtcttagtcttatgggagggccaagaggagtgtgtcagtctacaggcaggtgttgagcatagattcatggacctagcagagcactggctcctgtggggcaatcaaaagctgcagacaagcactgtggttgcagcagaaggccattatcctaaatggactaatgcaagaacagaaaaccaaatactgcatgttctcgcttataagtgagaactaaactttgggtactcatggacgtaaagatggcaacagcagaaactgaggactactagagagggagggtcagagcagggaaagggttgaaaaagtaactattgggtactatgctcagtatctgaatgatgagatcattcataccccaaacctcagtatcacacagtatagccaggaaacaaacttgtgcatgtaccctctgaatctaaaataaaagttgaaaaaagaaaagtatttttgaatgaatacatcaatgaatgaaaatgaaaaaatgctgcagacacaatctctccatagtcaagttggtgagctacagttactgctcatgaaactttaatgaataataaagatgatgtatacttttaccctaagctgtatggtactaaagtcagtgaaggcagggaacatagtggcccagaacagttaggaaggttttctggaggaagccagaatgaaactgggatacaagggtcagttggtatctatatttatttactcttcatacccctttagagggagtctgcttccacttttcagaagcctcagagaattttccaggaggaattagatcatgtacccagtagccctgagctaataaaatctggttgttaaattccacccttttctcattctccctcaagggtcttgtaatataatttgcatttctcaaatctcagctcctggtaccattttcttagaagtcctgcctcccagcacctcccaacactctgcctgatacttggcatgatgggaaattctttttttttctgctaatatttgtgcaggtcccatgaaaataaacaatctccaaaattgaacttgacccaaccaacatatttcaagtacctgtggtttcactatgtgtatataaatgcagatgcaacagtgaacagtttcctgtcctcaaaaagagtttaccttctagaccaggaaaagaaacaactatactgcagatagaatgtgagagaagctacaacaaagaaggatgagattaactgcaataggggaagcttttgtggaggggataggactggggctagtccataatgagcacctgaaatttacctatatggaagtggcagggtgggagagagggacatgctagtcagagggtacattgtggacaggcacacagaggtgaccagtgcagaaatggtccaggtttggctgaggctagggatgtgaatgagtgtcatggcagtgaagactggaatgatgaattgagtttggaacgtgagactgagaggttgggccctatactttgggtcaacccaacctttgcccaaagggttttaaacagaaaacagaggtgaattttaggctgctgctctggccatagcttacgtgtgcagtggaagcaggaggtggttacagatggaaggtggggcagggcaggtctctgtctggcagtcactggtgcaggtcgttatgaaggctgaaagtagggtagtggcgatgggcctggaaaaaggggacagatgagagagaggaggcagggtgacctttgcttgtctttcctcctccccaggtgagatacattgtcacgtaggcagtcatttcaggattgcaggaagctaatgatttttccccacaatgttgctggcttccaaccagagaatgttgcccttgagatttgacaatgactgttgcctccttggcagcgattctgaatcaagggcaggagtcagccttgctgggaagttgttcagttgattcaaagggcttgggacatgtctctgagactgtaggtggcaattcctgcaagttgcttcattccgttgtgtctttcccttgggtggagcctcctcttgccctctgagtggggccagaggcccagttccatccccctgtaggcatcagaaaagggctgcttcctgtgttcagtttagagctctttaaagcccctgctgacagatcctattcaagctaaaatgagtggctgggggcaactcatacataatttccttctatgtagtgacttcctgcaccatggggtctgcatgatttctgttcatttaatgaaaggttatattggcaaattgttatccttgggagtgtgggtgtgcagggagtgcttttggaatacattacagggtaattccctttgccctttattgcctctgcaggccatgtgtaattgaatcgcaaataacacactttagaaacaggcagagagactgaggcctgagcgtcctttggctttaatgagacagtgagcgtgtgtgtgtaaacgaccctctggttatgcgggccaggtggaagaggtagtcgtataactaatgggagtgatttttctccacctgccccagacagtgcaatcagcagccttcactcccgcagggagggtctcaatccagtggctggctctgcctttgaaacatccagagggcccattactgttaataggagcctctcccgagcacctgctagagactacctcacttacatgctggctggtggggttgaggtggccccatgcaactttcccgttctcatctccctccccagaggaggctgctgtgcccgaagttctgtgcatgaggaaaacaccaacagggggaaactgttacggcaaagttgcccactctcagaggagttggcaaaagtctgtgaagttcagagaatgcaaggtctttaagtgtggggaggtgaaagggtgggatgcagcaggggattaaaggcaagcagtgattacatgagacggtgtgatgtcttaggacactcagcactgacccccaactgggcaagagctgtgatcacaggtggatatggccacctctagtctaagaagtgtttgtccctgaatttgagggactgggtgttaatacctttgtgccccataacatccttccagttagtggtggcaccagcatttctgcagagcagaggtgtgagactgccatttgtgagggatgggagtgctatggagggaggagatgaaggtagacaggtgttcattttcagtagggtagttagggtgggcctcgatgaggtgacattgcaacaagtcttgaggaggtgaggcagttagtgatgaagacgtctggggaaagactgttccaggctgagggaccatggtggtgttggcacttcctaaagcagctgtaggcctgggtgatccaggactacaaaatgaacggggcaagtagggtgccgagaggtggggttggagatggattataaagtgctctgttggccgctgtaaggatgctggcttctattctgagtaaagggtgagccattgtggttgttgagctgtggagtgatatgaaacagaaatgaaaatagacgatccagtaaaatgaggaaaatgtatagatccagttgtacaaaggaagcatttgttggggggcagggagaggggctgtctatcccagcctgggcaggggagacagggagggcacggaaaggcttcctgggtgggcgggggagggtgtcagctgcatttgtccagggtcttaaatgatgggccagcctgtgacctcccaacccccacctgacactgtttctgtaaccaaggcagcaagggactagtttctctcctgtggattcttgggcaatttgtgtggtcctgtttgcaacctctgtgtgtgggaatcaatctatgcctcatcctttgggcataacctttgcttggaatccactttctatccactgacccttggcaaatcagtacccatgtggatatcttgcctagcaggatttccttacatgctaatgtgttactgagcactgcaatcccagggcagtgggagtgtggggcaaagaaagtgaggccagggaagtaggcaaagtagaagcaagggggtctgttgcaagctagccacagcctcacaagaaaatatagccagttttctggtcacatgagatgtgaccaggaaatgagatgagaatagtccatccagttagaggaagagagaacaatttatttgttggcacctgcctgtctcctcatactcattgataaagctctagtccatgaggatatagacctgttctactggcatgagtgcctaaagtggccacatggtagatagagcttcaagctcagtggaagctttactgtatccactagtcggtgcaacctctctaggaacctggtagagtcaaagtatgtggggttaggatgcacagcctccacaaatatttcataggggtggtggttagaatgacctctcctacttccatcacttggttcctgggtcagtttattgtagctgttgggaacacagtgtcacatgtcagccactggtttatcacctacaccacatcttgaaaggtagggcccagcccagcaaggagtttttttttttttttttcttccccataactcgttgccttaacttcactttcaataggctgctatgccattctgtcagtcagattgactctggggatggcaaagattagttagccccaggtcattgtcgtacttcctttgcaataaaatgggtcgcttggtgtgagacaatgttttcggttaactttcagtagatcaggcattttataagcctttgctcaggatttccaacaaaagctctgcaagccaggcagaatacccaagtccgcaatgtgtatcaacttcagcagggatagaccaatgttctttcccatgtggaaggggctcaatataatccacctgccaccaggttggtcttctcaaggaatggtgccatattgaggactcaacatcagtctgtgctgttgacaaattgggcattcagcaatgataacagatagatcagcactggtgagcaggagcccatgatgtttggtccatgcacagcctccattcctgggcaagtagtagggagtggaagagagatgccagctgacattcattaacatcatcttgtctaacttggctcctgagaactttatctggagtagattctctgccatggaaattcatgtgagatacaaagattttcaagcattgtgagcccttctgtaggtccctccaggcctccttgctgctggccttccaggtgtattccatccagctcctgacctatcagcaaatccacttgccactcccagaagttgatatctgcaccacaggccatgtttccctgaatacaaagtggatgactgagtgtctgccagaagctttgcttcctgggaggccactcttgagtgaggctatagttcagccacagtccatcttcaatgccaacatttcctgcaactcacctgtgaaccaggcccaggtccattctcctccatccgttggtcatagggaatggaaacccacatatatggaatgaaaaaaatggtgttggtactacagaggtaagtgacatggtagtgacctgaccatgaacttactttttcacgcaacttatactctgcatctgcttgagtctagtaccaaatataccactttaatcatataatggattgtgactacacgcacttggccttatgacttggtggatatagtattacttagcttgtaatggaggtcatacagtctagtgtttcaaggtcaaatgttagtttcagctagaactcagtaacacaagggagctattttttcaagtagaggacgtggccttgattaagaactctctaggtctgccctgagagtctcatatttgagcttgcccagcatccttatccaccgtgaacccccctgcaccaccagatttgctgcaacatacaggtcaagtagctgggcagcttgtgccactgcctgaacctgctacagagttctctgttcccctggtatcttcctgaatcaccgggtaaataaatttgagcagttttccaaagtgtggtaaacactgccttaaaattcaatgaatttcaatgagtgctgttcttcttttgtagtagcaggtgttctaggagcaaggatttctcctttagagcagtgtcccagcatgctccaagtcactggaagctctaaaaatgtcactgatttggcaggtcctaagtatttgtggcatttatctcccaccttccaccatgtatgtgttctcttagtaaattatctaagccacttcctgctcccccatgcaattattataacatcaagataatggacccatgtgatgttctgcagaatgtcaaggcaatcaagttccttgaggactagattatgacaagaaaattaacatagccctaaagctattatgttgaaggtgtactgtagtccttgccatggaaagactacagtactttgatgccatcactaatggatattgaaaaaaaaagcatttatcaactcagtagcaatatattcagtaccagagtccatgctaatctgcttcaggaagtatgttattttatctaacttatcagttagcattgcgactaccacttggctaattgtacggtagcttatggccatctgctatgctccatctggtttctgcagaggccacagatgaattgagagacatgatgtagaccactatctctgcctctttcagatttttggttgtggcactaatctcttcagttgttacaggaatgcagtattgcatccaatttatccaggcagaaaagaggggtagtttcagggggctgcatttagcctttattaccataacggctcttcctccacagtcagggaagaaacgtgagggtcttgctagttactaagtatctctataccaactacacacttagtgactgggaaataatccagtgtgggtcagtggacaggcacatgtgactcaggctaaagcactacgacatgacatcagtgtgtcctcacttcagtcagaggagcatggtgagtttttgaggtcctttggtattagtgtcagctcagaccctctatttaacagttaatgaaatttctgggttttctcttttctcaaaggcgaagttacccagcaaatgttttctttggggtgataattagaggcatattttctgcatatctctgcactggtgttacacaattcttcctcaaggaaacctaatcttttcttcagtctgctgtctactacctctcatggcctctagaccaataaccagtgccaggacttagcacagcttgagtaggggtgcacaagccctgttctaggaagtaatagatggtacctggaagggactgtaggacgtggctaatatatgctttggatatggagctttgggtctgtgagctgacttacgtctggaaactgggtgaggggactgtgattttctgctgtggaaactgatgacaaccttcagctcaccagcttgtgcatgcatgcgtggagtgtttgtgtgtgtgtgtttatttttgattgtacaaatcaagcaacaccctagtcaactgcccatctatcttgccccttgaaacaccatcaccatagatttctattgatcgaggcagcccagttgctactccagccttgctgcacattatgctaacgatgttaagggctgcttcctggcctttgccattttgggaacccattattgcctttagattaaggatctcggttccatggcagcatattcatggcaattcctgcctgcagtggacagccgccataaagaatctcaatgattcttgtgcccccttgatcagtacatttcttattgccttgttgaaggaagtgccctttgagtcctctcagagaatttatcatgtgatggggtctcaggttttacagagtaaatccactctaacagttccatccctctgtgccttctgaccccttcttcagaactatgctgaggaagtttcaatatcttcacccaatttactgtaggccatcattctgctcatggttcaaggagccctcccagtatggtatcaggactggttccaggtatccttatcagctaattgaatcccaagtctcaggttaatgttctcatgtcaatcaccatccccatctgtccctttcctttgctgagtagtctcttcaccctcaagagtcactcctgcatgcttgttcatgaacactgctagtatgtgttagcaaagttctacagttcatctagtatatagtctactacttcatagaatagggcctgtatatcactgtgcatgcatgctggcactggctattggtctggaggtcatgaggggtagttgggggcagatcttgggaagaataaataccattctgccatgcacctatttccaataatatcagtacgtgatctttcgacaagttgattgagggaggtgggggaactgttttcctctggcaatggggagaagcttctttggctggcccagagggttcaagattctccagcttaactacacgaatacccccacaccaggtttcgtagtcccacccttactcgttagggctctgattgtgacatacgagacaggtcgaggctgcacatttgacctactttgaaaatttaccacatggaaaagtcatgatctgggtctgattttcagtgcagttggccctgaagctgcaggagacaagagtctctttttctatggatacagaatctttgcacttttagaatatgcctgaagccagcaattagctggcttggtttcattttctttttgcaagacctcaaatgctttcacaaatagccatttcacactcccatcctcatagttgtcattatcttctgccaatcaaatgatgcagccatttgaccttccagtgtcttgcactttacctgcacctcatctcaatcaactgcaggtgaaagcttgactaattgtgatgtcaccacatgccacttagcagcagcagagggattctttttttttttctctttttagacaaatgagtatcaagaactgtgaagagtctgagattacactctagtttcaagccaacaccttacctttccacattcatggatactgaaggaagacaaagtcctttaactcgggcctagtagtgtcatgtcatttataaaagaccaaaggtgaattgtatcccaacagtcagtattccaactccaaaatcttataccgaggatgtcctggttccaaagtttctggttcgaagtccctagaaaacaaaacctgaggcaaaatgtatttcttcatgtatattgaaagatatattcccaggctgggcacggtggctcacgcctgtaatcccagcactttgggaggccgaggtgggtggattacttgaggtcaggagttcaagaccagcctgggcaacatggtgaaaccctgtctccactaaaaatacaaaaattagctgggcgtggtggtgggtgcctgtaatcccagctactcaggaggctgaggcaggagaatcacttgaacccgggaggtggaggttgcagtgagccgagatcatgccactgcactccagcctgggtaacagagcaagactccatctcaaaaaaaaaaaaaaaaaaaaaaaaaaagatagatatgtaaagatatgttcccagggcactgataacatggcgggaaaaggaagtgaggtagggatggaggaaaagcatatgatgctttatcaagctggccacagtatcacagacaaagacaaatgtaaaggagtccatttctcggctctgtaggacaggctgttattccttagaacagtcattcgtgggaaggaagggaaaggttggctctgccaattccttcccacagaggcactcctctgtgtagacactccatcctacccttcccagttgttgctgatggcctctccaggcagcctctggggaagtgagattcaaggccccacagtatttgcctctggctgtggtgggctatggtccccctctgcctgctcttctgcctctgacactaaccatccatgattctcgagatgctatcccatctgtttttacatggacccagtgggaataataattgctgcagtgattattttaaaagaatgttgtaagagagtaaacattttgaaaaattgtatgtgctgtagaaaaactagttgctatttatcagatttctcaaacttgagtcagaagaggaagaggaggcgcctgaacaggactttgaaggacgagtagaagatacatagatgaggacacaaggaagggcttctcaggtggagcattcagaggcgtggaggacaggggtgggagacagcatacaacagggccagcctgagcaacatagtgatatcccatctctacaaaagaggaaatatcagctgggcatggtagcgcatgcctgtggtcccagctactcgggaggctgaggtgagaggctcacgtgagtccatgaggtcgaggctgcagtgagctgtgaatgtgccaatgcactccagcctgggccacagagcaagaccttgtctaaaaaaaaagagccaaggctctgtctcaatcaaagagccaaatccagcccgccaactcattttgtaataagttattgaaacatggccacatccattcacttatgtgtcattgtgggctgtttttctgtagtttcaacagagaccatatggcctttaaaacctaaattatttactctgtggcatgttacagacccctgatgcaaaaggaaatattaagtatattacaaagttggtaattaatgaatataaattgcctttctcttttcatcttcctcctttgtctcacaaagaattgatcacataatggctacatagtaaacactgattagtgaacttagtctttggaaatatatttaataccattgcttactaaacagagttaatcctagaaatttactaatttaaaatcaataccataacctacaaagaatttgaggcattttattctatcccctttacatgaatcatattaataattgagacactgtcccacacataatcaccaactatttgaaatctggctgttctagaaaatctggaattaattgggacttggcattacaatgactctttaaaaaccacaaactgctgaacactgactgcgtttccacaggcagcaaagaaaaagtctgaaacattttctagattccttgaggggaggagttatgtcttatgtgacttggcatagaagggattaataaagaattgctgaataaataaagtgtccagaatagtgccgggcacaggataggttcttggtaaatgtttgttgaattatctggcaaaataatccattgattcaaatgaatgagaattttcaggccacagaacacagatcattgttagacccaagctaatgatctccataggttgcacacaagtaatttaaaatctacatctaatttatttgtcagaatgttgtataaccattggttggccccagatactggatgagcttcccaatcaatactacgtaacaagaaaagctacctgtcaaagacagaaagctcagtcaggagggacctcatggctgtgctgctttaaggctaattaactggtgtctgacatcttccagtaaatctaaattaaatgtattcttgtgaattctaatttcaagtgagtttaattgaacttgggagggaagctaccacttagtgagtaaaatgaaaatgaagtaattgaatatttttccagaattgtatttgaaatgtgctccatcaaatgttgtttcagaacccaagtgaccagctgcacatggttaatatttggaaagggaagaggagtatttaaatgtcagcttgtagccactagaagggtaaatacaatagccggctgttcagttactagatgtgagctctacttggcattcaaagctttttttttttcaagttggaagttcaataatgtgttcaagggaattaagatgagtttggacgactaaagcacaaaaaccaaaaccttctttccccacttctcccccttcccagcacacaaaaaggacagcagtgctgctgatttaaaattgcaggcattttgatgggcttaatcaactgattacacattaaagtgttgaaccctttatttaatgactatttattaaaggcccgtggtattccaggcactgcggaggatagacgattgaacaggacttagtctatggccttaaggaactttttgttccgtagtgagatgagacctgcgaattaagtggtatagaagaggaaaatgtgacgcatatggtaagagcaagcaccaagtgctgaaagaaggtagacttctggctgtgaaaacaaagcactcctctcaggggaggtggtatttgagctgtaaatatttgcagaaggaaaagaaagcatgggacctacttggaggatgatgaagcatttaattgggctggtatggaggatttgtggaatgagacagtacgaaataaaatagctggtgtggttataaagatccttaagtgggtctgtactttattcagtacacggcctctcagcagggaaggggtttgatcagaaacaggaaagaagaatctagatgtaatgctcactatcagaaaaattcaaatccaaaccacaatgtgataccacctcatacctgttaggatggctactatcaaaaaaccagaaaatagcaagtgttggagagcatatggagaaattggaacccttgggcactgttggcaggaatgtaaaatggtacagccactgtggaaaacagtatggagattcttctcaaaattaaaaataaaattactgtattatctagcaatcccacttctggatatatatccaaaaaagttgaaatccaggtctcaaagaaatatttgtagacccacattcatagcagcaccgtttgccatagccaagagaacccttgggcactgttggcaggaatgtaaaatggtacagccactgtggaaaacaccgtttgccatagccaagagatggaagcaacccaaatgtccatcaacagatggtatatacgtgtagtggaatattattcagtcttaaaatggaaggaaataccatcagatactataatgtggatgaaccttaaaggcattatgctaagtgaaataagtcaatcacgaaaagataaatactatatgatttgacttatatgaggtatctaaagttgaaaaattcatagaaacagaaagtaggatggtggttgccagggactaggaggaggaggaaatggcaaattgttgttcagtgggtaaagagtttcagatttgcaagaagaaaaatttctggagctctgtttcacaacagtgtgaatgtacataacactactgaattgtaaacttaaaaatggttaagatggtaaattttttattatgtgggctttcaaaaccataataataataaaaagaatatagatacagcggcatggtatgaattgtattggggttgaaagagagagaaagtgggaaatcagtttagaggctgttgccctaggcttgatgagatgtaactagggcagggacaggaggaaggaagaggagttctcaagatagaattagtaggatttggcacctgcaggaaactcgattgaaggagagtgtcagagatggcttggaggttcccaaccaatgctaacgagaaaatgatggaggctttcccagaaatagtgacttatgtggggagataaggagtttggttttggattaattctgactgcaggttgtggccaattgtgctggagctggtctaattatactgtgtgctaagagctgttggaagctcttttttgtttgttttgcgttttctctcatgtttctatgtgtttgaccttcaacttcttagttggccttgctcaatggtttatccctaacttttcaaattaagggcgagttgcacattttcaaatgtgggtctctcaagagttcgttcactgaatccttcaatctggggttgaatatctacaggattggttgtaaaaattagggagctatgaggctttctttactgaaaaacaccgtttaaaaattttttatcctttttcattagaaatttaatttccaacctggtcaagtgaacacaatgcccttacctttttagtgtggcatcttattcgtctaagctggaagcagcctcagaggtgtgagcttatttctttactttaggcatttcacagggaccagaggtttacaaatgtattcgtgtcggtgctctataaggtcatcacctcaagattcccagagtggtggcagtagtagatttgtaattccaaatctatgtttccacagttgagagaattctgctgaaaatggaaaaggagggtaacgaaatagactggtttcaccttggcatggattggtctacaaagataatcacccatttgagtattgagaagtgtctttttagtgtttgctataccaggaggtaaaagaaacatttggggacattttcaaaggccaggatctgggattggaatgggatgcaattttaaggtcattattctgtcacttatgtcagaaagaatttttgttactgatatttgtgagcaaatgattgcaagtgctgacatgaagttgagctttgtttaacacattgcatacatatttcagccctgaaagactcagatacttagaaaattttccttaggctttggagaacaggttacattttgagacaagatttttatagaacaatatgtgactctgtaagaaattataaatacttttctgaaaatcagatgatcttggaggcagttccttaatgccactgctcaaccttggagaagaagatgaaattcacagcaatgctccagcctcagcatgccctcccaggcctcctgattttgtcaggaaatacttccttgaagattaaagctataattcagaatctaagtcaaagaagagtaccttatttaaacccatgattttaactcacagcaataaggccacagcagacgggagctgaacatctctgtagactggaccatctggaccatcacttgcaagtccttctctcaacattgttgacgtcccctaaataatggctctgcattgactggtgccactgtcccaagagtggttccatgctcagctcctttgcctgcctgtctgcctctctttgtagacaagcaattaactgattagatccagaccttagtatttgacttgtttctttttctctgtgtcatgggaattcacttcctgttttaggacattttcccttttcagcctgatggacctgaggattttttattcattcatttttgacccagtgttcacagatttttacactcatgtttctctgttaggtgcccctaaatgcctcctttagtgagatgccttttcctcccccaaatccagaattgttcatcctttttttgtagaagtcatggagttttctcgagtgagagatagtaaaaggcctggagctcgagctgggctggcacaggtacatggtggctactgggggcatcacttctaccacattacgtggatcaaagcaagtggacgagcagttcagattcaagagaaggggaaacaagctctaggttgggatgtggatgtcctggaggggaggaattgtggcagccaactttggagactcctacactaggcattaatttacattccctcacaaaatctttggaaacacaaatattttgataccaaactgttgacatcttttgggtgccagtgaacctatattttcttactctagattccttattagtagtagtttgcaaatcagataaagccaaaatagtttataacaatgtctgtttctccaccaatgctttaccttgtattaataaattgaaccttacccatgtgttctataaaaagaaattcttacagtgtaagtacttagtgactatttaaactgacctacagaattatcttccactcaatgttaagtaccacaataatatccctgcactgtgcacggcaatatagtgtagcaatggagtgcacggacctgagagccagattgcctgagttctgatatgaactctgccacgtactaactgtataaccttcagcaagtttcttaagccctttgtgagtcagttttcttatctataaaatgagagacctaataataccaccatatagggttgtaatgaaggttaaatgtgctcagaacagtactagacatatagtagcatacaggatggttcaactactattgttgttgttgttgtcattgttatgacagagcgatcagcactgaatgtttagggcaagtaatgtgagtgggacagttggaacagccaaggtacaaggtcacctctcacccatggaatgccatgacttctggcccacacttatgcccaatccatcttgcttcatccagctctagtgggtgcatggcacgaatgttgggcaggctgggcagccctgtgtgttgccttcacttccatgtaatgatggagtgcttttgtatgccttccatgttgtgaaagacaaagactctctctatcattcaggccgtgattggccgttctggtctcagagttatatggctaatgtcagtcttttggtgttataccagagcctggtaacaggctggtcttgtctctcaaaagaatatctaaccttagcccttgctggagttgttttagtccaggacacagttgcttttcagtttgttcacctatgggacatcacaaaatctccaaaatgcattcacattcatgctgagaaatccagaactgcattctcagccagggcctagggttcaagcctcaagaatgtttgtggcatctggagacctgcttcctggagcaggtcctactaaaaaaaaatgacaatattcctgggtactttagatagaggatactgcaaaatactcaaattggatgtggctagaaatatgctatcccaggaatccagatagtatgtcagcttttcttctgttagttggtggatcaaagtgtaggagtttttcttgaccttgatgggaatgtctccactccacccatacatttaaacccaaggaactgagttcaaaacacaggtcctggatcatgcctgtgttaatgacccatcttcagttccttaggcaactctctaaagctaagtctactttttagtgtagtatcaccttcactcatgatcactgatgtgttgcgctagttacaggcatgtggctggcaccaagggccagtgttctaatgagcatgcctatggccattgcaagatgttaacatatccctggagctgcctggtaaagagaattctgtgtcctttgtgtccagctgttcagcagactagaaatcctgataatgactttcttgcttaaaataagtttaaaatgctgactaaatcatttaaatatgttttcaaaggcattaatgggttagcaaaaaataaagaacctaataggccacaatgggcatcagagagatgttgtgaccccatgcaggcatttgccagattaggtgaacttggccattagttcatacagccctgggagacagatggacaagcctcagatgggaaatccaattggtccatccaaaatgggaactataatcggagactcccactatcccaatccatgttaagttaaaaccccaaataattgcaccttcagggtaagaataaagtaggaataagcctcaggggatgacaaggaaaattgcttgtctcaatccttgattctgagtggaagacaaaaattctcctataagaatttaaaatctttttataagaattcacacaccctcacacagtttatatgctctgacatattttgtagcctgagctcacactgtttagatggtctggaaaacctcagatagaaaatcgagtattaagttcaggttggttgtgccagaggcacctggcaagaggaaacaaatcctctctggaggaactcacttgtatccaagacctcagagaagtctcacagataatgtcagaagtgggggaaaatgagctcatattttgggggcaaaattgtgaaaccacttatggaaactgtactaagagtggagagcctgaaaagacagtgatttcagatacaggcataccttggagacatcgcaggttcaattccagacccctgcaagaaagcaaatgttgaaattaaacaagtcgcataaaatttttggtttcccagtgcatataaaatttttgtttacacaatctgtagtctaagcattgtgtctaaaaacacaatatgcataccttaattttaaaaagcttcattgctaaaaattgctaatgatcatctgagccatctgtgagtctttttgctagtgaactgtcatgccccaatgttgttgactgctgaccagtcaggatagtggttgctgacagttagggtagttgtgacaatttcttaaaataagacaacaatgaagtttgccacttcgactgactcttcttcaacaaaagatttctctatagcaagcaatactgttttatagcattttatccagattaagacttctttcaaaattgaagtcaatcctctaaaatccctgctgctgctttatcaactaagtctaagtaatattctaaagccttcattgtcatttcaacaatgcttataacttcctcagcaggagtagatttcatctcagtaaaccactttctttgcttatccataagaagtaacttctcgtccattcaagtttgaatgagattgtggcaattcaatcacatcttcaggctccacttctaattctagttcccttactatttccaccatatatgctattatttcttcactgaaattttgaaccctcaaagtcatccgtgaacgttgggattaacttccttcaagcttctgttaatgttgatattttgacctcctcccatgaatcataaatatttttaacggtatctagaatggggaattctttccagaaggtgttcaatttactttccccagacttatcagaaggatcgctgacagctatagacttatgagaagtatttcttaaataattagactcaaaagttgaaattactctttgatccatgggctgaagaatgaatgttgtgttaataggtatgaacattaatctccttgtacatctccatcggagctttcaggtgaccaggtgtcttgtcaataagtggtaatattttgaaaggaatcttgttttctgagcagtagtatcaacagtgggcttaaaatatttagtaaaccatgctataaacagatgtgctgccttccaagctttgttgttccattcatagaacacagacaaagtagatttggcataattctgaaggaccctaggattctgagaatggaaaatgtgtattggttttaacttaaaattaccagctgcagctgcattagcccgtaacaagacagtcagcaagtcctttgaagctttaaatcctggcattgacttctcctctttagctatgaaagtcctagatggcatcttcttccagtagaaggctgtttcacctacactgaaaatttgttgtttagtgtagccaccttcatctactgtcttagctagatcttctggataacttgctgcaacttctacatcagcacttgctgcttcactttgcacatttatgttatccagatggcttcctttcttaaacctcatgaaccagcttctgctggctttaaacttttcttctgtagtttccttacttccctcagccttcatagaattaaagagagttagagtcttgctctggattaggctttgggttaagggaatgtagtggctggtttgatcttctatcaaaaccactcagactttctatatgtcagcaataaggctgttttactttcttattgatatgttcactggaaaggcagttttaattttcttcaagaacgtttcctttgcattcacagcttggctaactttttagtgcaaaggcctaactttcagcctaactcggctttcgacaagcctttcttactaagcttaatcatttttagcttttgatttaaagtgggagatgtgtgacttttcctttcatttgatcaattagaggtcattgtagcattattgattggcctaattttagtatcattgtgtctcagggaatacggaggcctgaggatagggagagagatgggggaatggccggtcagtggaggagtcagaacacacacaacattcattaagttcaccatcttatatgggtatggtttgtggtgctccaaaacaattacaatagtaacagcatatatcactgatcacagatcaccataacagatatagtaatgataaatgcaataaattttggttattcttactgtatttcactggattatagtacagtgagaataaccaaaaatgtgacacacagctgaagtgagcacatgcttttggaaaaaatggtgctgatagatttgcttgatgcagtgttgccacatgtcttcaatttatttttttaaaaatacaatgtctgcaaagtgcattgaagcgaagcataataaaccaaagcattcctgtgtcagtattaatagacacagattataactaggtttaatatgcttaaagtaattaacaaaggaacttaggaaataacaaaggaatatgatgctttaaatgattaagcagagttgacaaagaaccaagttaaaattttagaaatgaaaattataatagtcaaaatttaatgattatatttaacagatttaacagccaattagacctagctttaaagaagattagtgacctgaaataaatctaaggaaagtatacataatgcaatccagagaggtaaagagatggaaaaatgagaggataagagtcgtagagggtagaatgagaaagtttacagatatctaatgagaatttcagaaggagaaagggagaatattggaaaagaggcaatatttaaagagataatgtacttatctaaaactaatgaaattaaacagtttcaggaaacatatttaatctcaagaaggtcacatcaaaaagtccacaactcaacatatcataatgaaattgtaatgccaaagacaaatgtaaaatagtaaaagaaaaacagtgtatatagctttcaaagaaaacagcccatttttaggtcctatttgccttccattttgaccagtggggaaactaaatggtaagtagacaaatttgcttacttctttctcctggacttactttctttctgacaattatttaagacctttgttaataggtacttgccttttggaaaaatcaagttgtaaactttttctccaaattaaaaatgaagttcttcaacatctcaacttgaccagatataaaacaattttaaaacctttaaaagcgtattgagaaaaaccgagcttttcaaaaacaacatgcctgtcattatcaaaaagaggcatatttaggtaaaaataacaaaaaaaaacccttgctgcatagatattgcaaatagttctagttatctggtcagtgggtaaaaagcaaggacttaaggtcttcagctccaatatcttgctcatttcttattgctggaatttcatatccttttcttcctgttggatgactaaatggagtggtggtggagatggtaagcccacatttactcagccacattctgctcagcctcaggagtggatgaattctcagcttttgtctctaccatcttgtcgtttggggtgttctgagcatcagggctggtacttgaagttgtggctgccccgaggctgaagtgtctgctgaccctgggttcattgccttggttttccttacccatgtcattgctgtcctctctcggtcatctttggcaaggagagctcctgtggaaccgtggtctctagccccatccacatcccgcctcactggtttaccttgtgcccctgcgccctggctgtcagcacctccacttcttctccctgcaagggagggtgggaatactgtgattgcccgcaggttatctgagtgtagtgaggtgtgcaccctgtgggaccactgtcccatcctgttctttttctctctctcactattgaggacccctatgacgcggagtctatcatggttgcagcctgctccacgtttacctctttgacctggaattccaccagggcctgtgacacttgctgccagggtcctcctctccttagatgacatcgaactccacagtcattccatatcctaccctgcgaaggtacttcctggggttattcttctttacagcagtctggtacacaaatgcatcttcctcggtatcattcctcttggtgaaaccatatctgtttcttacgctgaaatattttattgtctccaaaaccttccttgcaatgaccttttccccattggcaggcgccggcgctgtccgtggtgctgggcttggtgccggcagcaccgagggcagggacgagggcggtgggggccgctggcggctcctgggccggggacttgctgctcctagctctggtgactgtgactggggctggcggcaggccgtggggctgctcagggttccctgcgggccgctccctcctggactttcttgactgtgtgactatattcttaattttcccggaggactttttgatgagcctttagagtactctgtgaacttcattttgactcatcagtgtggctgcaggtaccgggtaaggaaaaccttgggtatgcatggctggggtggggaccagagtagggggcaagacacatttgtatgatcagttaaataagagtgttgatactgggtggatcaaacctttattctaattctttttacatattttccttttatatatgcactgcagtgccctaaaaaatgccatattaggagtgctgtatttttaatttttagtacaaaaattacttttctgtattaaaaatgtatttgtattaaatttatgatcaatttagtcagttactgacagctgaaaagctacttcagagaggagaggaggctcagcctagattccctttggacacaggcccaggagcttgcaggcagaggatcagctctgggaggccccagagagagtttatggtgagcagaatcctcaccaggtagtccccaggcacctggcatgtggcaccgtgcttgctcctgtgctcacctgctttctgtcctgcagtcagcaagccactctcttctgccaaagcctggctcactggggacacaaaggtcttccctactagttgaaagagccagagaaattcatctcccttaaggaaggagaggagagagagaaatagaagtttggaggggcaggatgcagcctattaatgcacatatacttttctttgcttcactctagagtttggagatagcgagagatgaaaagaaagaaatggaaagggatattatgagggaaaaacccactaagaatgagatattcttaataatctaaagaaatccagttttctttttttcaggtcaaatcctgcttgtcctcggaattctttaaccatcagctgtagatttagaccgaggaggtttattcgatatttaacgtatacttaatggtcatctgctgtattccagacacttctacacaacggagggtttgatagtgaaaaagagacaaaactctttgaccttgtggagttaacatctagtcggagagacaggaagaaccagtacctagagcatgccgatcgctggtgaatgctacaaagaacaagcattaagtgacctgggaatgtgaggcaggagggggaggatgatggctattctaagaatgatcagggaggcctcagaggccagatgatgtgggcacaggcctgaacagggtgagggaggtagggtttcaagggactgagtgggtttgcttctagtagcccctcctcagccaaagaggagcctccagggacccctaatccaggctagacaggaggtactgctgtgcagcagcaagagcctctctaactccccaaatatccaccctggttggagggagatgatgataaacgtgtgagggctaaaggggctgcgaaggctctgtggagggcaaaggccacaaataccaggcccgcgagctgaattcataactgggcaccagctcaagtgtgaaccaccctggaaggaactgctctaatttgcgaaccttgaaccaagctgagccctaaattaatctcttttttttctcactgaactgagcactgaaccaaggattttttcaaaacagcaacagctagtaagccagtttgaaccagaaccaagcctattcattttctaaaagtattgaactggaacaatataggaatattaaagtatctttcgaactaaaccaggattgaactgatcattcacaagtgcccagcttgagaagagaagaaattctttttggagagacaattctgtgtatattaaatgtctgccttgagagtcattccctaccaaaaaattacactgccttgtgacctctttttaaaattttaatcttgggcctaattctaatatttaacttttcatttgtacatttcatttgcctacttattcaaatgttcttgatgataggaaccacattttgtattgcctggaaatgttagcacaattcctgggatacaatagaagtgtgggtatatataggggaataggggtgtaggagtgattggtggcatgcaatgaccaaaggcttgaaatttattctgcaggccagaggaaactgtggaagggattcaagcagaaagtggcaagatcagatttgagttttagatggcactgtggggaaggggttaggaatggagattggttcgaagtgtgtattatagtaatccgggtgtgaatcagtaaaaagcagtggtattgtgtgagccccagaggcagaaactgcctagattccagtcctagcttcacatgtccttgctgtgtgacctcaggcaagccacacaacttctttgtgcctcactcccctcccctgtggaaggtagatgctaatgatgcttactccatcctgtgcttttgaggtttatgtgatacattgtgtgtgaaatgtagagcactcagaatagtacctagcacatagtaagtgctcaaaaaaattcattattaattttcattgataaagtaattatatatatatacacagcacatatatatacaccacatatatatacaccacatatatatgtatacaccacatatatatacacaccacatatatatatacataccatatatatacacaccacatatatatacataccatatatatacaccacataaatatatacacaccatatatacaccatatatatacataccatatatataccatatatatacataccatatatataccatatatatacataccatatatacaccatatatatacataccatatatatacaccatatatatacataccatatatataccatatatatacataccatatatataccatatatatacataccatatatatacaccatatatatacataccatatatatacaccatatatatacataccatatatataccatatatacaccatatatatacaccatatatacacaccatatataccatatatatacaccatatatatacaccatatatacacaccatatataccatatatatacaccatatatatacaccatatatatacaccatatatacgatatataccatatatatacacaccatatatataccatatatacacaccatctatatatacaatatatatacacaccatctatatataatatatatacacaccatatatatataatatatatacacaccatatatatataatatatatacacaccatatatataccatatatatatacacaccatgtatataccatatatatacattccatatatataccatatatataccatatataccatatatatacataccatatatataccatatacacaccatatatacaccatatatataccatatatgtacaccatatatatacaccatatatataccatatatatacaccatataccatatatatacaccatatatacacaccatatatacaccatatatatacaccatatatacaccatatatacaccatagatataccatatatacactatatatactatatatataccatatatataccatatataccatatatacaccatatatataccacatatataccatatatatacaccatatatataccatatatacacattccatatatataccatatatatacattccatatatataccatatatacaccatatatacaccatatatatacaccatatatacaccatatatgtacaccatatatacaccatatatatacaccatatatacaccatatatataccatatatgtataccatatataccatatatatacaccatatatataccatatatatacacataccatatataccatatatatacacataccacatatatacactatatatatacacaccgtatatatacacaccatatatatacactatatatacacacgccatatatacacacaccatatatatacacaccatatatatatacaccatatatatatatacaccatatatatatatacaccatatatatatatatatatatatacacacaccatatatatatatatggtagcagcaacaggattggatatgggggaggagagagaaggagaagttcatgatgagtctgccatttctgatatgtgcagttaggtagatggtgaccacatgaatgtaggccatttgggagaggaatcaggttggaaaggaaaattttaaacatgttgagtggaaggtgcctgcaactcatccacttagggttctccagcagatggtggactgcataggtctggtttttaacagagcaccacaggctatagctagatacagacatgagagtcatttgcagagacctagggtgtgttgaaatcaccaggagagaatgtcaagtgagcggagcagagggaccatcagagaaggtgggaattccaagtagggaatgatcaatagtaataaatacaccaaaaacttccgatcaactaaagactgaaagtatttccagtggtgatatggcttcattgactccatagctagtggggtttctccagagggaggagagcagaaggcaggttatgggggatgaggagcagctaggacgtgagggagtagggaaagcatgtataggcaggtctttaaggaaccttgattgttaagagatgggagacaagatacaggtttctcattgagttgccttccctaaatcagggtttggtttcactggctaaaccagggggaccttataaaaatggtccaaggcgtaatatggctgatgcctccacatcctcctgagaaagaccttctccagaacaccctacctctcctagcctctcctttcaactaatgacatgaacgtgtttattgcccatctcttcgccagtaaaatccagggtccatgaaggcaggcatctttgctgccttgttccttctgttttctcatcattcagtaatgcctggtattatttggcatcaattcctgtcactcgctgtgtcactttatcacacaaggcttctattatgggacccacaggagaattttcgctcaggccttataccaggcatgattaggccttccctgagcagccgaattgttttcatcacacggacactatgccctgttttatgtttccctctgattatgcttttctctatgctgtggtcacagaaatggagtcaaatttccatcctatttctagcagatcatataacatccaggcatgggtttttgtgtgaattcattcaacacaccactaactttgagctttttttatcctcatcttattttccatttatctgatttcctcctttctttatatttgatgtttgtttttcttatccagagtgcagtttcccaggtttcttcaaatattttttggaaaaaactgaggttatatgtcaataatgggaaaaataggatggtaaataggacttgtgtggaactgggttttgagacaaaagaaatgaaaaagggatgaggctgactttacacgtaaagggagcaccctgaggggataggggaagtggggatgtgatccccagccctagcgggtttctaggagatttcagctttgttggagacacatcaaagacactaggaagagagtaacataacaaggccatagaagagcatgtgctgtcatgaatggttcagggggttgtataggggtaccaaagaggaagagagcatcatagcatatatgctggcatgttctagaaggctccatggaggattttgggcaacttcagcctcaaagagggaataagatctaaatagagcaagtgaaccttacatttgtcaagaaagatttgagtgtggcagtggcttttggggcaggtggccagaaatctaggtccacctttgctgggaaggaggcactagctggagtttggacggtagtgggatgttgaggtcgctttgtagatttcagtttggaagccccaaactgtgggggtgtctttgccaaggtcataacaggttggactcctctcttgcttggctgctcgacttgcccttactggccgggcttttcagacaagtgcattcattcctgcccattcagatctgctttcttcactgacctcggcagcagagaggccaggtttgattgaaatttcacttaaggtgcacagagcatcccttccttgccgaactcatcagccagcaataaatggaacttcttgacagtttcaaatttcctgccagggagcagctggtgagtgttcctctggagaagcagtcttggagaaattttatcagtatctggctagagaaagtattttctacctctcctctcctttcctctctttcatccctctcttctcaccccctctcttctcttccccttctcacccctccccttttatcattgctctcttcttcttagtcttacctgtaaagactttgcacttctttagtccttagccactgaaaattaatttagggacaagagaaggccttctctacacagccttctgagttactcattactgtctttaagattcaaagagcaaaccctcttttttcaaggcttctcttaatgagccatttcagcatcggacttccaattttcacccctgccagaaaacagccgctgggaaggtttgggaaaccagtctcccttccagagacttgtagctattgggctgcaggagcaatataattattccccattagtgctctatgaaagtgcagatggtgtacaaagtcctgatgctgttttgcttgcctttttttcacccttcctgaaacattttggtttatgtcccttcatttcagaaaacaaaggtaaggcctggctcagtgtatttgggtgaatatcagagtacagtatcataaatttcctatatggaacctataatttcttgttatttacctaggcatttgaagacacctgttagcctccagcaggaaactgtgttaatcacaactccctttgctgctacaggaagtgcctggtcccctcccaaaataataatcagtcaccttaaaacaaaggcaacagcctgaaaaataacgtggtgataactttattagtgatccccaacaaggcaaataaaacagaagtgtagatgtcatctggagaagagatttcagaccttggctaagctccaccatcccttttaccaaacctttttgttttctctccagttctcctcggctctgagtctgttggagattagaagtatttctgacatgctgtgcaaatatatgcaaattcattgtgagttgtcatcaactccactttcccccatgtggctgggctgcctgtgcagtgctgggctgctggcctcctggaatcgcagcaatatggcctatgcaccctgtgccaggagccattagcagccttgatgcatcggattagggagctctgatggctccatggtgtcagtgagtggtacccgggcttctaggctgtggaacagcacaaagcaatgtcaaaggcagagggaaagatgctgatttccactgatttttaaaatatccacttggtttcccaattttactttcatatatatgcagccacagtagaaattggctatcatgacagcagtgattatctgatgatgtccttatacatgcatatcttttagtgccggtcttttaagttgattgctgctgagattttccagaggagcacatcctgatgtgtgtgtgggcaggcgtgtggctctctgtgtataaacacgtgcagagtgtgagccacacaagggtcaacactacatttgcatattaattccaaataaccaacatgtgactcctaacatgggcatcctcaagcaacgggaaaattgtcttgattttcttgagattgttttgggtcctcccatcctttcctttaaggtttttcctatcttcactcaccctcattggcctgtttgtagggcccaatgagagaggaagagtgggttctgggtgggtgggagaatccgaaaggaaaaggtatgggtaactggaagagaattttaagaacttacgtgactaccaccaccttcaaatacaactcttcaattgagagcagaggattctttgctagattccattctgttacctctcttgcccatatatcaccatgcaaacagtaaaaaggtgaatgttggactcacataggacttttatgtaattgttataactaattaagagtcataattatttcccactttggaacaaagccctttctaacaccctacttattatgccatcacctggagtgcatatgaataaattcctgctgctactcaccctgaagctgcccaaggaagaagcagctcaaacaaatcttagcccatgcatttggagaggctgccctaatgactcactgatagttattgagaaacagattatctctgtggatgtctgaaagagaagggaatggtttcaagggctcagcagtctccagagaatatattaccaaagattcctctatgactgtgccctattaaaatgtatggaaaaacaacctggattctgggtccctgtaaaaggctccaatctgcatttatcattgaatctgcatcatcttaggcttacacttcagttatgacgacaatatggggcttgacaattctgtcatatttttgatatttaactgatgtatatttttttaatttttaaattttattatttcagtaggtttttggggaacagataatgcttgattacatgaataggttttttagtggtgctttctgagattttggtgcactcatcacccaaccagtgtacactgtacccactgtgtagtcttttataccttgctgccccccaccctttaccctgagtccccaaagcttatcattcttatgcctttgcatcctcatagcttagcttccacttatgagtgagaacatatgatgtttggttttccattcctgagccgcttcactggatggagtctccagttccattcaggttgctgcatatgccattaattcattcctttttatggacgagtagtattcatgtatttatataccacattttctttatccactcattgatgggcatttgggctggttccatttttttgcaattgtgaattgtgctgctataaacatgcgtgtgctagtatctttttcatataatgacttcttttcctctggggagatacatagtggtgggattgctggatcaaacggttgacctacttttagttctttgaggaatcttcacactgttttccatagtggttgtgctagtttacattcccacgagcaatgtgaaagtattcccttttcactgcatccccaccaatacctattattttttgattatggccattcttgcaggagcaaggtgtatcacattgtgttttgatttgcatttccctgataattagtgatgctgagcatttttccacatacttaatggccatttgtgtatcttcttttgagaattgtgtgttcatgtctttagcccactttttgatgggattgttcttttttttcttactgatttgagttctctatagattctggatattagtcctttgtcggatgtatggattgtgaagatttcccactctgtgggttgtctgttaactctgctgcttatttcttttgctgagcagaactttttagtttaattaaattccatctatttatctttgtttttgttgtatttgcttttgggttcttggtcatgaaggctttgcctaagccaatgtctagaagtgtttttcctaagttatcttttagaatctttatggtttcagggtcttagatttaagtctttgatccatcttgagtggatttttatatgaagtgagagatgaggatccagtttcattcttctacgtgtggcttgccaattatcccagcaccatttgttgaatagggtgtcttttccccactttatgtttctgtttgctttgccaaaaatcagtcggctgtaagcatttggcttgatttctgggttctgttcccttggtctaggtgcctatttttataccagttccatgctgttttggtgactatggccttatagtgtgaagttggggggtgtgatacctctagatttgtggttttttttgttgttgttgtttgttttttgcttagtcttgctttgactatgcgggctcttttttgattccatatgaattttaggattgtttttcctagttaagaatgatggtggtattttgataagaattgcattgaatttgtagactgcttttggcagaatggtcattttcacaatattgattctacccatccatgagcatgggatatgtttccgtttgtttgtgttgtctatgatttctttcagcagtgttttgtagtttttccttgtagaagactttgatgttcttgattagatatattcctaagtattgtattgtatttatttatttatttatttgcagctactgtgaaaggagttgagttcttgatttgattctcatcttggtcactgttggtgtacagcagagctactgatttgtgtacattaattttgtatcctgaaactttgctgaactcatttacaagttttaggagctttttggatgagtctttagggttttctatgtatacgatcatatcatcagcaaacagcaacagtttgacttcctcttttctgatttggatgccctttagttctttctcttgtctgattgctctggctaggacttccagtactatgctgagtagaagtggtgaaagtgggcatccttgccttgttcctgttcttagggggaatgttttcaactcttccctgttcagtataatgttggctgtgggtttgtcatagatggcttttattaccttaaggtatgtcccttctatgccgattttgctgcaggttttaatcataaagggatgctggattttgtcaaatgctttttctgtatggagatgatcacatgatatttgtttttaattctgtttatgtggtgtatcacacttattgacttatatatgttgaaacattcctgcatccctggtatgaaacctacctgatcatggtggattatctttttaatatgctgttgggtttggtttgctagtattttgttgaggatttttgcatctgtgttcatcagggatattggtctgtatttttctctttttgttatgtcctttcctgatttggtattagggtgatactggctttgtagaatgacttagggaggattccctttttcctctatcttttgaaatagtgtcaacaggattggtaccaattcttctttgaatgtctgatagaattcagctgtgattctatctagtcctggactttttttgttggcaattttttaataaccctttcagtctcactgcttgtcattgctctgttcagagattctatatcttcctagttaaatctaggagggttgtatacttctagaaatttatccatctcctctaggtcttctagtttatgtgcataaatgtgttcatagtagccttgaataatcttctgtatttctgtggtatcagttgtaatatctcttgttttatttctaattgagcttatttggatcttctctcttcctttcttggctattcttgctaatggtctattaattttacttatctttttaaagaaccaagtttttgtttcatttatcttttgtgtttttttttttttttttttggtttcagtttcatttagttctactctgatctttgttatttcttttcttctgctgggtttgggtttggattgttcttgtttctccagttctgtgaggtgtgacttagattgtctatttgtgctctttcagactttttgatgtaggcatttaatgctatgaactttcctctagcatggtttttgctgtattccagaggttttgtcattattattgttcagttcaaagaatttttaactttccatcttgatttcattgttgacccaatgagcattcaggagcaggttatttaatttccatgtatttgcatgcttttgagagttccttttagagctgattttcaattttatttcactgtggtctgagagagtacttgatataattttgattttttaaaatttagtgagacttgttttgtgggctatcgtatggtctatcttgtagaatgttccatgtgctaatgaatagaatatatattctgcagttgttgggtggaatgttctgtaaacatctgttaagtccatttgttgtaggttatagacttaagtccattgtttaagtccattgtttctttgttgactttctgtcttgatgacctgtctagtaaagtcccttactgttattgtgttgctatctatctcatttcttaggtccagtagtaattgttttataaatttgggatcaccagtgttaggtgcatatgtatttagaattgtgatattttcctgttggattagtccttttaccactatataatgtccctctttgtctttttaaactcctgttgctttaaagtttgtttggcctaatataaggatcactactcctgctcacttttggtgtccatttgcatggagtatctttttccacacctttaccttaagttgatgtgagtacttatgtgttagatgaatctcctgaagacagcagaaacttgcttggtgaattcttattcattctgccatcttgtatcttttaagtggagcatttaggccatttacattcaatgttaatattgagatgtgaggtactattctattcatcgtgctatttgttgcctgaataccttattttttcattgtgttattgttatataggtcctgtgagaattatgctttaagaaggttctattttgatgtattttgaggatatgcttcaagatttagagctccttttagcagttcttgtagtgttggcttggtagtggcaaattctctcagcgtttgtttgtttggaaaagactggatctttccttcatttaggaagcttagttttgatggatacaaaacttagctgataattgttttgttttggaggctaaaaataggaccccaatcgcttctagcttgtggggctgagaaatctgctgttaatctgatagattttcctttataggttacctgatgcttttgcctcacagctcttaagattctttttcttgtcttgactttagataacctgatgactatgtatgtaggcgatgatctctttgcaatgaatttcccaagtgttctttgggcgtcttatatttggatatctggatctctagcaaggctggggaagtttttctcaattattccctcaaatatgttttccgaacttttagatttctcttcttctttgggaacaccaattattcttaggtttggacatttaacatagtcccaaacttcttggaggctttgttcattttaaaaaattctttctttgtctttgatgcattgggttaattcaaaagccttgtcttcgagctctgaagttctttcttctgcgtgttcagttctgctgctgagattttctagtgcattttttatttctctaagtgtgtccttgatttccagaagttgtgattgttttttatttatgatctctgtttcactgaagaatttttctttcacatcctgtatcatgtttttgatttatttaagttgtacttcatccttctctggtgcctccttgattagattaatacttgactttctgaattattcttctggcaaatcagagattttgtcttggtttggatccattgctggtgagctggtttgatcttttgggggtgttaaagaaggttgttttgtcatattaccagaattgtttttctggttccttcttttttgggtagcctatatcagaaggaagatcttggattcaagggctgctgttcagattcttttgtcccaaggagtgctattttgatgtggtgttctcccccttcctctaggaatggggcttcctgagagctgaactctagtgattacttttgctcttctgggtctagccacctagtagagctactgggctcctggctggtactggggaatgtcagcaaagagtcctgtgatatgacccgtcttcagatcttccagtcgtggataccagcacctgctttgatggaggtagcaggggaatgaagtggactctgtgtgagtccttggttgttttatttagtgcactggttttgtgttggttggcctccagccaggaggtggcacttttaagagttcatcaactgcagttctatagggaggatgcaaactcgccctaggaacaggtttctcaggtggtgggcagggccatagaactcccaagagattatgacctttgtctttggctaccagagttggtagagaaagaccaccagctgggggaacggataggcatttctgagcttagcccctcccagggcagggctttctgtggctgctgtgggggatgggggtgtggttcccattccagtggagttatactcccaggcagattatggctgcctctgctgagtcatacaggtcaccaaggaactgggggaaagctagctgtcataggcctcaccctgctccaagcagcctgtagtcctaatggcctcattccctccatgctcccccaacagcactgagtctatttccaggcagctgatgaccagggctgagaacttgcaccagaccatgagcttccctattgagaaagcaagttgactcagtttttggcatctcagggagcctgcaggggtaatccagtttcttcaaagcatctgtggattctctcagctttcctggtatgttcctgcagtcgtttttggagcaaatgttcacattgtgagtctccacatgctactctgtctgtccaagcaggagctgcaagctagtctttcttcctatcatatctatgattctttagcaattgaaagtctaaagccatcattcatctcctcttgccatgatatctaaatataaatatgtatttcacatgtctcctaactggcaagagatgcccctcagtggaattttagtttccatcacctgtgaaagaaggagcaagccactgccaaaaggtggtcactcagcctcttgggccccagttctagaagctctggatagtgactgcctgtcgttggggtgctcaaaatctctttgtgcttgaagttctcagagagaacatatatcctagctagttctgagctgctcttcctgtggacacccttcaatcacctcttcagggaagagcctgtctctcccaactgtcccacagagagactttcctcagactgacttatgattctctcacacttctcgattttagctcctactagtggcattttgtgtggcatattttgtgtttgcacataaaatagaattcaagcaaagacttgaaagaattaataaccatctggtgactctctgtcacacccataaaatcctagtataatttaaaaatatatatagtttttgaattcatttgttgaaatatttaaataatgttttcttggtataaaagaacaacaatggggtgcctaaaaatgctccaaagtgaattgtgtacacgacctattctatatttggagttagatttcttcagcacatctttccacatttgttggaaatctgttcacagttggtggaaatctgtccagctgctttcatgtgatatgctaataaataggcatgtgccttagtctgtcttctgttgcctataacaaaatacctaaaactggataattaagaaagaaaaggaattcatttcttacagttatggaggctgagaaattcaaggtagaggggctgcatctggtgagcaccttcttgttagtagggactctgctgagttctgcagtaggacagggcatcacaatggtgagaggccgagtctgctagcttagttctctcttcatcttctttttttcttaattaaaaaaattattaatacataatatgtgtacatacttatggggtacatgtgatattttgttgcatgcatagaatgtgtagtgatcaagtcaggatatttagggtgcccaccacctggggaagttatcacttctatgtattgcaaacatttcaaattctctcttctagctatttaaaaatatacaacacattgttaactgtattcaccctactctactttccaccgttagaacttagtccacctatctaactctatgtttgtactcattaaccaacctcttttatcccctttacccaccccacacacccttcccagctcctggtatctatcattctactctctacattcataggattcaccttgatagctcctgcaaatgagtgggattatgtaatatttgtctttctgtgcctgacttatttcacttagtataatgaactccagttctatccatgttgctgaaaattacattatctcattctttttatggccatatagtaatccattgtgtatatatgtcacatttttaaaaatccattcatccattggtggacacttaggctaattccgtatcttggctatcgcgaattgcgctgcaataaacatgggggtcaagtatatttttgatacaccaacttctgttcctttggataaataccaaggagtgggattgatggatcatatggtagttctaattttagttttttgagaaatctccatactgtattctacaatggttgtactaatttacattcctagcaacagtgtatcagctcccttttctctgtatccttgccaactctgttattttttgtctttttaataatagccattttaactagagtaagatgatatcttattgtggtcttgattttcatttccctgatgattagtaatgctgagcatttttttttcatatacttatcagccatttctatgttttctttggagaaatgtctatgcatgtcctttgccccctttttaatggggttgtttgttcctttgctgttgagttgtttgagttctttttatattctgaatattagtcccttgttagatgaacagttggcaaatattattttttccattcaacaggttgtctcttcactctgttgtttcctttgctgtgcaggacctttttaatctaatatgctcctatttgtctatttttatttttgttgcctgtgatcttgaggtcttagccattgtattagtccattctcatgctgctatgaagaaatacccaagactgggtaattgataaagaaaagaggtttaattgactcaccattctgcatagctggggaggcctcaggaaatgtacaatcatggcagaaggcacctcttcacagggcagcaggagagagaatgagtgttcagcgaagggggaaggcccttataaaaccatcagatcttgtgagaattcactcactatcacaagaacagcatggaggtaaccactcccattatctaattacctcccaccagatccctcccatgacatgcgaggattaggggaactacaattcaagatgagacttgggtagggacacagccaaaccatatcagccctaaattatttgcccagaccaatgtcctaaagtgtttctcctatttttttttttctagcaggagaaaaatccctaaatactgcttattctataacccaaagataaccacttgatagtttcaggtcttgcatttaagcctttaatctatcttgagttgatttttttctcttctgataaagccaccagtcccacttccatgataactcattaattcatgaatccacaaatggattaatccatttatgagggcagagccgttatgatccaatcacctcttaaggccccacctctcaatactatcacattgggaattcaatttcaacatgaattttggaggggacaacattcaaaccatagcagcatataattaggaaataattttatttatatatagacatgagatataatgaataaggaataataccaggtagtgctcagtgaaatataaaaaggtggggcaaactatagtattctatatttggtaaagccttaaaagagatagaagaagtcttaaaaataagtaggtaagcccctgtcctgctacgtggtggggcataggtttcattagtgatgggtaacatttatgagtgcttactgacatcagtactgctctgagcatttcacttgtgttttcttccttgttttaagtatacttactaaagattgaaaaggataagaatttgccccattaggtagcacagctaaaaagtcccaagactagggtttgaacctcaggagtctacattgcaattctgatcactacctggggttaggtcaaatttcacaggttaaaggcatggtcccccacaaaactgacctcatcccagatatcagctgcaagctcaagaaggtcacagaccgcccatacctctgacaaactgaatttgagtgttcccatgacctcctcagctttggcaattcactagaacaactcagagaacttaggaaagcactatacttattattacagtttttactgtgagtgatgcaaatcaggaccagacaaaagaagagaagcacagggcagaggagagtcccaaacatggttatctttggaacgtgtcgccctcccagcacaattaacaaagaatctccagtgagcttcagtgttcacagtctttattgtgatttcattatgtaggcatggttggttgaatcgttggccatgtgactgaattcaatctctagccccaaaatccttctctgataacatatggttcaaagccccaaccctatagtcacatggctggtctttccagcagggcaggccccaatctataaactctctagggacttacctgagtcacctcattagcataaactcagatgcggtctgagggtccacttggaataatgaagacactcctactacttgggaaattccaagggtttaaaggctccctcccaggagccagggacaaaggccacacaaattctctattatacaacacagtcatcctggtggtaagggaacttgagtctcatcaaaggacttcagaagactctcaacccccttctctcctgaggcccaacattaaacactaagctccacagtaaggctcctgaaggaacatagacttctgtttctgaggtcgtgcctgagctctagctgggtgggttagtagaagggctgccctccgagaattggagactaaatgctcagggtcctcagaagtttcctaacaagagggtgcagatttgctctgcaaagactggaagccacatatttggacagcaaacacctccatgcattgaaatgactaacaagccagaggagcctttcctagaggtggaggacagcatcttgttaagtgtactaaaaaccatatctgtaaatcagctgccgtttaaagcagttagcagtcacttaccaccatgggcaataagcatatgctgggctacacctgccatcagccccagggagcctcagagaggttcctggttcaccatttcacagacagagacattggtgaaggagtatgggtcacagatggcctgggactgagaaatgtctgctccaaccttatgttcccagttgtccaccagtccatacctgttggactaggagactcagaacttctagggtacagaactctgggtgcttggagtactcattaaatttgcaagctctttggtctcccagaagaaggaagcagatacaagggatggggccccatggaaatccagagaggccaggctgtgctgaagggagacgggcatcagaaactgctggggtgggtccaagagctgggaaaccagagaaaagtgtttctggaagctttactaatcattccttctccccagcatgacttattccctctcacctgcaggccttagcctgacagatcagtatgcaatcagtctctcactctacctatagggagtggatagtaaccagctcaatgtatgttgcctgggttttagggaaacaaacacatttctgattgttcaaaataatatatgagcattagagagaaaatagagagatgcacagagcaggacaaaatctctaaatactgcttattctataacccaaggataaccacttgataaatttgatatttctccatctgagtccaatgctaacctaatctcaaatatcatatacacactcacacacacagacactcactcgcacatgtccctcactctccggttgctccttgtctgaacttaggagctatgaatacattcagacatagagacatacttataagtagtatttgaataactacattttcattcctcaaaaaatttttaaaacaaaacttggatagttgtgaccttgtgtaaattccttaactgctctgactttcaggttactcatctgtgagtaggtataatgacccctgcctcacagaactggctattagaaggtctcaaagagacaaaagccctgaggcactggcattgtgcatgtggtgcagcagggacccaggcaccattagttctccctctctcactggatcctctctggctccaataggtcatcccagccccaccttgactcacctgtctgcaagcatctgctcatggtcctgaagcacctagatggataattcatgggcaaagctcagagaggagaggactgtgtatggctggtaggagaggggctcttggaagccatttgccatgggtgcagatggcataaaggaggggaggagagaggcatttcccaagcagtaactttaatattttcaaatccatatatctctaactatgactgagaggctcaatggagccattggcatggatcaaatgaatgagctagtggttgagatggttggtcataacatttgtaagcatagtcctgacaggctacttgaattttgactccctgcaagttaagcactgggatggtttttgtgaagcgggttcactgggcactggttacctacttgtctgtgtccagtgagacaaaacactcacatacaagacatgaagtgagcttattgtttgcaggcaggcagcaagagaccacagaagcctaggatgtaatttgagccagtctccccaggctcgggaaagctgtctggggctgctagtctcatctactcatgccccacctgtaccacagctgagggaccccagaaagcagcctgccctcagttttatactttggggctcttggaatcactgggataaagtgttgaaggacatactgtttttcagggttgagggcaggctgaaacagagcctggactattccagccagttcctccctatttaaggttgttgcaatcttagcacagtttccaagtgttcttgagaatcacaactgagaaagagggagaactgggttggtctaaggccacccagagaatagtcctgaaattttgactgctgtatggagttcagctctttttgttcatggttctattttgtttactttactgccataatagatctgataaaatggataaggaacattgatgttataatatacaaaatgaatgaggagtgtaattgtgatgacagttcttcaaacatgcctcaagatgatctttacctgattgtatgttgcatttatttgcttactatctgtacgtagtatataaggatagctcctgaactcccaaaggcagtgttaaaaagagaaaatagaatgatgattataaccaatctgaattttcgtttattcagattaaagggtttctttatccaaaatgtattatttgcagacataccaaaaaggaaaacaaaaaagcctaaagcataaaccttttctatctcatttaaaaggaaaaacacacaaaatataaaagttaatgagtttccttttaaagtgaacattgcaagaattcccagcatcccatcgtgaagcaaggtttgcctgtttctgatgcaccatcatttagttaaacttcaatctgcattttcatatagattcagtctccaaaccaaacctgatattttataacactttggaatttattgccaacaaatcaagtttttctaacataattaatctaaagtaaattaaactgtgtgcttcacttggcaaatggaaataagtaaaaatctgactacatattatgaatattattaaatacaattaaaaataaaatttataatacattcttcaatactacactaatttgaatgaaatatgttaagcttgaaatcagttctgtatgatattctaaacaaaaatgacaaaatggtttttaaaattccaaaggcagttggtaagatcgtatgttagtgtgagtagggttcacaaatcaaaaaatgtagtgctgagggagaactctgactctttggacaagcttgtggtgtggctaatcagagaagtgtcatatttgctgcggaaggtgattttttctaaagtagccaggtgagggtgcaggaccatttgctgtcttggtaaataacagcaaacactgacttaatatgtactacgtgccaggcattattgattaagcatttattggtgttagctatttaactctaccaaccactctgtgaggcaggcattgttgctaatgtcatccccattttacagatgaggaaactgagagccaaagtccaagcaaagtgatgactcaagtccaggcagactctatacattgaaccactgtgctacgtgcgtatcgaaaagtgcacgaactcatggttgacttctcataatacttgggtttgtcattgttcctcaccctcacccccagtccccaatccccagacaaacaccttgtcattgtcaggtgaaagaagctgatcctgtgttcacctgggggctccctttttcctcttccaagggtgttaggctgtaccttggctctctgtcagtctagggctaagagtataacttggggtaattatgcatttcttcattcttgcctctatgctggtgtacatgtaaacttggtaggagctgctgaactgtaagtaaacctaaggcgtatggattattagggaggtattgaagcatttgctggaagaataggcccagttaaccagagttggctcagcacacctccccaggtcagtcatggggaaagtttaagggattctgaaagagatactcacggagagatgagggcactgaaaaggataagggggggtacagcccccttctccctggcaccctaatggcctccaaacactcatagtcctctccacaagggtgtgttctgggtgtgcttggtggttatggtttgtccttgtggaaccacctcaggcagatcagaggttggggattccagtttcagaatcaggttggaatcctccctctactctttatcagctatgtgacctcaggagagttacctcatctccctgagcctctgtgatctcatctgtactagggacttaacaatagttttcacctaatggagttgttgtgaagattgaataagaataaagtacacactagtgcctggctcagagtaattacacagagcgcagtcatacatttatgcatactgcatttagaagcttgctgtcactcccaatacatagatacttttacagtacacacatgtattcatgcatatttcaagtatttcttattttttatccctctggatggctgggaaacttagactttccaattaatattttcattctttattgctgcataacaactaccccaaaacattgtggcttaaagcacccattattttgttatctttcatgattctgcgggttgactgggcttagctgggcagtccttctgtgcccatatgaagtcagcttgggctgcaatcacctggggatttagctgggctcctgggtcggttctgttcaagatggctcaatcacacggctgcactacatgtggtctccgtgtgacacatggttgggttccagtaagatgtgtcccaggagtgaccattccaaaagtcccaggcagaagttgcaagacttcttatggcctagccccagaagtaggacagcaacatttccacagcattgctcaagaaaaccactaaagccagtgcagaatcaacagtctgcaccccgtctctactaaaatacaaaaaattagccgggcgaggtggcgggcgcctgtagtcccagctactcaggaggctgaagcgggaggatggcgtgaacctgggaggcggagtttgcagtgagctgagatcgcgccactgcactccagcctgggtgacagagcaagactctgtctcaaaaaaaaagagtctgtgtattccaccgctagatatctggagtagcaggtgtgtccagggaaggaattaatggcggcagcttgggaagtctgtctactatgtacactacactgacaaatgcaaaagcgcacatatactgttttgttattttcgctttctctcttctccctggatggttgggaaactaagtcttgtcaattaacatctttgtctgttccagcttaagagtatcttttcagttcgaatattaaaactgaatttctttttttagatggggtcactctggccccccgagtgggagtgcagtggtgcattcacagctcatggcagccttgacatcctgagggttaaggtgatccttccacctcagcctcctgagtagctgggactataggcgtgcgccaccatgcccagctaatattttgtattttttgtaggggtgggtttttgccatattgcctaggctagtgaatattcaatttaaactaagttaaattatctaatagagctggtttgagtagcttcttttggataacttgcagtccaccttccttcttttcttttcaagatggcctctggggatgccctgatgtcctgtggcagcaggagggtgggtgatacggggatgggggttggcctgctctcccacttttccagtaaagaaaggctgggccagatctgtgactgttaaggcagcactggtccatctggccttaggggatgcagtgggacccaattctggaatccctagcccaggccacttggttttgatcttgacatctccaccgatacagacctttgtcctgtctctccatgtacccctactgtggcatgtcagagctcctgggtctgtgttctacctgtccttccccactgcctgccactgtacaccctcaccattgctcccacaccaagttggaccccttggccggagttatccaaggatatctggagcaagggatggtctggagggtcacaggctcccccgtgttaagctgaatttatctacatctttcccacctcacccctccttgaggtgtggctcccagatcattggtacctgcctgatttcttctctctagctctgttcccctctgccacttacagtccccagcccattggaacagtagtcaggctttgcaggctccttgcaggatgtgcctctgccctgcaacagctctgcttagagcctagcaggcacaggtggaaggtgcatcctctctacaccgtggaagagataatgattacatcctctggacttggccctagatatattaaataaatgccagagaaatttagaaaactttcttggcaatgtctagcagtcaagattcatgtctcttaaaaaaactttttaaaaagcctattttggtaacaaattgaacaatccttttttctctctgagttcttgttttaacaatcttaatactctagccctattaccaataacctctcccatggtcaccctaccagccagagtatctgccactggctgacatggaagacaattatttcgaggaaatgcacagtgaaaaaaacacagtaatatatttccaacaaaacaaaacaaacctcaagttccctaactagtagctacaattgtgatgaccattgtccccacccagatcattcatttattggtggcaggggccagttctggttactttgacgttaacctgccatgtgacttcagcaagtcaccagcagtaggtggcgttctgccaaggtttccaccacatctctaaggccccttccagcctaagtctccttctagtgacaacctgtggacagtgggtgagaaaatgcaagctgctgaccagctgacactgagcagatctcttagttattgactgaccatttatccaaccaaggtttccaaggactgggacattgtctttttcaccactgtatcccctgcagctaaaacagggcctggagaatggtatacattcaataaataaatatttattagatattgagtgactgctgactccttcccactggtcctccccagacacctgtcccacgtgtgatgtttatcaggtatcagaatgcaatatccccaaatatggtaccttggcatactgaatattttaaggtgaaggaaattgagaagatcacagaagcaataaggtcactctgatcttcttcctgcttcttctctcctgaagtgggtcatagagactagaattcccctcaccctttcttccttaaagcaactaataaaacctaagaatgtcactctctgaccttgtccctcctttctccctgaagactctcatacaacaggtatcctgctatatacctagagggaaggaatgtcacacagaagccaagaagaatcagactaaacagggcttgctaagttcctccctgtttattattattaagtcataaccttttgtcctctgattgtatttctgcatgactgtccgtaaaaatacatggttttccctaggtctttgggtcttcatttctgaagcctcccatgtcatgtaaaatttatatgaagtaaatttgtattattttctcctgttaatctgtctcctgttatcggagtcccagccatcagccttgcagtgactgacggaaagatcttactttttctcctctgtcctttgtttctgctttctgggtcctggcaagcccgtgaaggctgatgtctgtgcccacctcttgctcgccaggcttttgagggagggaaattctcagcgtccttggccattctttactggctttcatagtgagatgtgtacctcgtcagagctgagggggtgcctctgaggaaggtggcatgttctctggctaattcagagcttctcatcagacaacgggtctctaggaatgaggagcagaccctgctcagacattgggagcagcaagattcctagaatgagatggaatggtccacaatatggaatatgcactctaggctgatggttcacctcaggaggtggccttgggtgttcaatacaggacagggaagtgccaaaaatgatagagggtgtcttgggggatgggatgcagatagctgacatttcctattcttaatatctctcagcataaagcaaagaacatacaatgtcagtgggggctcacctgaggcctgttagttcagaagttctctgcatttttcagccggccacactctgataaccttcaggaaaggtattctcacatttgtacctacagttacctcctaggtaaagccaagctgggtcatgggttatttgctccctgcttacagctggaacgctcttccttcttccactggcctgtgatgggccaacatgacagaaccttaacactcattgggatacctagtgcagcacctagcacaggtgggcatttggggaatgtttgtggaatgaatgaatgaaacaaagggcaagagggaggatgaatgagagggaggaagagaagtaaaggaaagagaaaggaatggagaagaaagattatttcatattggtgataccagtgctcatttagaagtctctaaatttttgtaatagcaaaagattaaaaataacaccgatgtccatctatagggtcctggctaattaactaactgtataataagataaaatgcgcatttttttttaaaagcggacactcttcaggttttggtatgaagaagttttcaaggtactaaatgtaaaaagcaaagtcactccgtttgtgtgtttaggggtgtgtgtgtttgtgtgtgtattaggctacttctgtgtcaaaaaagagaggaaaaataagaatattttatatatttacatgggtcatataaacaaactatgaaagagtatacaggaccctaataaaaatagttgccattttgggggaggttagttgggggaaggaaaggaggaagaaacaggaggaaaacttttcactagctctttaaaatggttgtgcctggaaatatattactcttgccaaggttgtagtttaagtccctcaagtcaggggagcattctagttgaatttcctctatctagtgccctgtgaagcatgtgactagagctctcccttgatcatggcaaaattgatttgataatagaatctgatctttttcattttagccaaatctagctcatctgaaccattgccctccagttataagggaggaaagagagaatgactcagctcaaaggaactgcttagatatggttacagcatgctacttctcatggtaaattatgttattgatcgccaaatttgtgaacagtttttacctatacaaagtattcagttttataagtaaatgtttttaaccattgaaagaattggtaaaattcaggaatggttacctcttgccaggattcttggaaagatggaaaatcggaaacaagcatctgtttcactgctttttctacatttatgtctttatctttgaacaagtacctactgaacacctattatgggtgaagcttagataaagaaagtcagaaacatatgtgggtatattgaaaccattgacattcccataggggctttttttccttttttgctatgtttggggggaatggttaattatcattgcactataaatgtattggcataacaagtggcttatattcttcactttaataacaatctgtaatttcctgagtcataataataaggctttaacatattagctcagtgaagacttggtcaatgtctttactgagaaaaatatgttatgacctagcacatgataccatccattataatgttcttggtcaataatcataattttattataattattgaaagctagggtttcccctctgtgcagagtgttgtaaagacagatgcatgagattgtgaaggatcaaggtgttatccataatagtacattcagctggatttatgtccctctccaattagaggacaatcaagctcaaattaatttagctcacagctactaatgagcaacagcaaaatcagctcactataaaaaaattgttattgaattttattttctccaacttgatgaatgtctatgcactgcgagtaatgtgtgtttgaggtctggtggtgagggaccttgagggttgtctcatccgccccgttcatgggctctgtgacagctccgttccctggtgcaacaacatttaatgagttgttagaggtccacagagatgggcttcctctgttaactgagccttgacagtgcttttgagtgaattttctggtctaaactgctgatataaatataatgcaaaccacatacataatataaagttttctagtagccacattttaaaaagtgaaaaagaaataggtgacattaactttaatatattttatttaactcaatgcaatgtatccaaactattatttcaatgtgtaaacaatataaaaatattaatgcaatagttttcattctttctgttttgtagtaagtcttcaaaatccagcgtgtattttacatttatggtacatctccagtactctagcctcctttcaaatgaacaatagccacaaggggctggtggcttccacatggcacaggatgggtctagattgaatttcttcattcataacaaagctgcatttccctctttggagtttgtaggttgaggcaaggtgagcacaggctttggttgctcaatgatgataaagaacatacacaacctataagcaggagaagatactacattttcatctttactgtgagtcttgcaagtcattggcaaatttacagtctctgtgaattggcttatggtccctgtcaccatccacctcccacactaataaaggcagaatagatcctcataaatatcctttttccccattatcagagcttcaccaattgtggcctcataaaaaaagaaggttgtttattattattattatttgttgacataaaaaatgcatatttttctgaagcctgacttcccactagtactgttgctttgacatcaaatagggcatgaagcatattgtcaaatacatgtttggggaattagaagccattgagtgtttcatctctttggcaatgttcctgaggaaagtgcatatttaaatctaggagaatattttaattgtttaatattgtaaatgtttaataggaattctgaggcgtaatgcaaggactcactgaacttgattactgcaaagtaggagatgtgtaatgagagtctggagctcggggttctcatcacttggagacccttatacactaatgaaatgggatgcccaggataggggcatgggggagtacatgaggaagaacagccgctgatattaccactccaatggatgcagctacaaactaggcttcttgccagcacacaaggccctctgatgacactctgataagcttcagcctggcacaatctcatcattgctatttccaccctctttcctctcaaagtaaataggtagctatcagattcctgactggtctttctgtttccagccctgtcctcctcaagttcatcctctacccagctgtcagagagctctgtctaaaatgcaaatgggaccccatcactcactgctaaaagcacttcggtagctccccattgcccttggattagagaccatgcatttcttaacagtagcctacaagctgtcctgtgatctggcttctctggatttccttctcttcccttcctctcttctttcctttttctgacttataatttatattcttacaactccgacccacattcctgtaatcattcctttcctcccctcttttggcttcttccccaccaaattttaatttactttctttataagtcataagtcagcctttacctcctccaggaagcttcccccactccactccaagcaaggcaaatgcctttgatactgctgtggtacttgcatcaaatatatgcacatcaatcataatgcctatttgtgtaaccatctgccatctgcataacaccttgcctttcatttttgaatccttcatgccaagctcagtgcctgatgcttagtaggtactcagtagatgtctgctggtggactggccagacccatgatgcagtggtttctggggtttggggaactgcctttcctctctgttggaagatgaggcatcacctctcattcagctcctgagatcagcctgggcactcattcccctacaagagggaactgatgatgagactaagtcttcagcccaatgcctgcagtagggtcctcagaggcctcactgcctgccaggcatggtgatgaaagtgtattgctttggttcagttagatgaggtcttgggaccccaccagcaatgcagtgttttgaagggagtgggtagagggaggatgcctgaacagtcaggagtttaatgtccatcttgatggtgatgagagtcattgaagcatttttagcagagagtgggagaatcaggtttacctggaccaaggctcttccagcccagcctcaactgcacgtttctgtattcctgcagtttataagggaagaaatgcagaggaaggggtcagagagagggatctgtgtcagttagaattgcaatctgttgtaagtagaagaaaattcaaagaacactgagttaaaaacaagattgggggttatttctttcccatctaacaagaagcctggaaatgggctgttcagggccagcacagtgtttacccctttgcctcattgtcttagcacacgggcttcgtcctcatggtcacaggatgacttcgcctttccaatgggaacaagggagaaggatgaagggtccaaggcaaaaggacaagctactgaatctatttcctggacagccacccagtggcctctgcttgtgcctcggtcacgtgggcactgctagctgtaaaggagcctgagagacgttgccccaacaaacttgaagttctgtgaatagcgaaagaacaaatagatactgggcgggcaactggcattaacaccctgactttccaacatcttcctgagagtttgaatttatttttttcctggcattaacactctttgaatttaccttgtttactagtttgttggcttgtggtgtctgaccctagaacatatgctctgtgagaggaggagcctcttttctctgattctgtcctgcctgtttcacctctgactcacaccacagggatgggggatcccgcagctccaggccttcagatccagaatgaaaatcctcggctccatcccccagagggatatttggaagcatctctcaaagaggtaaggtatctctggtatttggcatacaaccaatttcaccagactggctgcctctcctccatctccgggatcttgttctttttcttttcccccccttattaaacaaattagccaagatgacactggatactgattagcaatttgtatagcaataaaagaaaactggcagaattccattgttttgctctccaattcttcatttccatttttaatgtactgtgtcttcattcatttgattgggtttccttttctgtgtatgtccttaatggaacaaagtgttcttcttcccccaacccctccaataattgtgaacattaaagagctgcttaaattgttcagtcatttcattttataatttgagttgggagtatttatggcttttcctccccttccctttgtgctaaatcaatagttgctgtgtaaatgcgacttaaactgtagcatggaggcaagctcttctacttctagatccttccctgtggccccgccggctgggggatttggagtccctatctgtcaaaggccatccttagccttccggtcagccccacgttgtgatataaatgatcagcacacacatccccttcttgaggggagatgccctctctgggctcctatgttaacctacttgtgctttcaaactcataatttttcctctaaaatgatcgctcatttatttgtctactggagattctggagggaagggactttatcctatccatctctgcctccctacagcccccttgagagaatgctagacatcaatagatgcaggatttcacttaatcatcaattaatgactgattgggaagaactgaacaataacaaaagccaaaagccaaatgtattctctgtgataggcattgttctttgttgctttaaagacgttaacacatttaatctttacaattaccgtttatgaagcagggattattatcctgatttcatggaggagggaagtaagccaggaagagagattgagtagctgctttagggttacaagcccaatatgggggacagcaagattgggcccataatttggccctgggtagtgtgagcatggagcctacctgcttagcccttgcagagcacagccttcttgtctgagtagaagctgccatgtatttatatgacatctgggccaggaagcagagcctccttccctctctctgactcaggagcctccatgtggggaaaccattccaaccctgttgactccagcaaccttctgagaatagatataaatgcaaatagcaggaactgcattgatgtggaccttccttaatgcctgaaaactgcctggaagctgccacaacagtgtatgcctccccttggcatgtgcatgtggctactggaagccctgggggacgaggcccaccccatacagggcagagccctctgaagagcctgctgcaggtggctctgccaccaccaacttacgtaacaaatcactccgagccatctttactctgtaaaatgcaaatgtctgtaggtgctggaggcagcctgccaagaattcctgtggccaggaatttcacaaaccagacattacttttttaaaagagaaaagactgaagttaggtattcacctgttaaacattaagaactaagaacattaaaaaaggagaaaagtaaaataaaaaagaccatcttttgtcaccatcgtttcataaaagcattttaactccctaaaatataagtgggactatctcagaaaacaatgaacaatccattaaattgaattctgatggttaacagatgaaaaactcacactgtccttgttttgttcatccgttcagcttagacctgtgaaaattctattgcccatcattgaggtccagtttttgggaaaaagtaatgtagaaaaaaaaaaggagtccaatcctagccctgccatccactgcttgtgtgactttgggcaatttagttagcatctttgatctttggtttcttcctctgtgaattgggagctgcctttcagtgctttttaaagattaaacaaggatatgagggtgatgtggctgcaacatctgtcaccccactgattgccagggttgatttggctgatctggctggctagacgggtgtccctttcctccctctgctccatgtgcatccctcctgaagctgcatgctccgctgaagaggatgaccttccccaacagaggagaaatggtctttggtcaagggtatatgagtagccgtgctcccctgctagaacctccacaaacaagctctcaagattaaatgaggcgtgtgtggagtgctcagaacctgggggaagagtttggactatgctcagaattttcagagcagcaattctcaaaatgtgatcccagacaggcagtatcagcatcacccaggaacttttgagaaatgcaaattattgggcctcaccccagacctgctgaatcagaaactgggagtggagcccaggaatctgtattttaaccagcactcttgttgattctgatgcatgctcaagtttgagaaccaccattatagggaaagctgtcacctcagtcacagtggccactgctgtggccatgtgtgggatctgtgagatctgatagagcagccagaacacctgtgaagagggaacgaagagggtcttgagtttccctggtaattattcagttcaatctgcactttgttcacaatccatccttcatgggaggaggctttacctggacatgttaagcatgggtcacccacctacctgtcagcattagattcctcatccataagctcaggacacctgtgccctccttcccacctagcagtggtggtgacattgctctgcagagagtgagggctcccttcctcccatctagctgtctctgatgtcaagattgccaggagtggggacaagcaacaacctgcactttgccattgatcagcttttctctgtgtctctcattttctctattgagtgacacttggaggtgggcctagtgtctgcccaagtctgctgctacatgatgctgtcagcatctttgtcccaaaatacggctataattgggtctctcccaaacaaaacagtccctttacaagatacccagagaataaatccaaagtctatcctgaaacaccacagcctccaaaatctagtacccactgtctgaattttttaaaaaataaattttaaagatgtaggaagcacagagaatagtattattacatgtactcagaagtcacactatcacatgttactgtgttgtcacatttattttattattttctagtgaagttattacaagtacagtcttctttcccctccttgaattcacgcttcagtcattttcctctgcgaatcgctttatacagcccatactcaagcctgacaggaccatgggaatttccagtggaaactggtgccatattgcctccctacatttgtctgtgtgggacccctgactagaatgtccccctacccatcagctgcccctggaatttgagagttcactcaaatcctactagctcttcaagcaccagttgaaatgccacacctcccatgaagcccgtgggttttctttcccacttctcttaaactcccccagccctccccactgtcaccttgagctgggataactttcaaatccctgcctttggagcacaggattgattcagagcacgaggctgaaggctcagcttggccattgactgagtgtgggatgcttgacagactcaatgccctcatctgtgaaatggggataataatgtcttctttgcaggcttgagagaaaatgtgtgacggctgtaagggatgatcatgcgagggattttataagtaatcctaggtaagggatcatttatgtttgctaatgctccctgactttcgtcatcatttgcggtgatgcatgcacgtatctcaactgcctgaggacagagtgaatcccggcctgatttaccttttatgctacgcagaattcagtttgatgctttcccacaatcatgactcaataaggttgactgaggagtgggtagggttacgaacactgtgatcgtttctgcctgtcttactacaaggtggaggaatgggacttccctttggccgtcagacatacagcaagtgctcactgtgtgccaggcacaggactagctggcagtggaggcacaaatatgttccagacatgatctccaaggccagttataggcaaaggtcacgtgtgtgacaaggaagacatgtcccttcatgttgtttattcattgcctgagcagcagctagatggggagagctgctggggcccaaaaaagggggtgggggagcattccctgagtgcctgagataaatgctccatgaaagtggacacggaacatctcacaagtgtcttggaagcaacctccttcgtgacatcatgacaaatggcttttctaggaaaacagaccaaatgtgagcaaaaaggtctgtgatcccagaccccaaaagttctgaaaatgggatatttactataacttacttggtggcaaaacctggaccaacctgatatgaggctatttatggtattcatcctcctgagtgtgaaaatccatgcctttgctgcagaaatatgtgtgtgtaatgacaggacacttccccagaccttattggagatgtttttagcatgcggtagatgcactgtatcaccttactaaaatctgggaaattttgaattcctacagatatttgaccccaaaagttttagccataaggattgcagacctgtagaagctgcagcagtgagggactgccttccagtcaatcctgcctcccactaagtttttcttcctgtaggctcccaggcaaatggttttcttctacctggggaaggccagtcccagtatcttcaaagtgcaggcagggctcagctcaacctgcagccaaaccctagtgggatcttttacttaattcagaagtatgtttttcttaatgtgagaaacacagctcagcatgagcttacaggaaaggtgggcttagtgttgcctgcaggcatcttctgggccttattggatggttgcaccatcctgctgggcttaataccccacactgcccatcccccggagcacctgcatactctggactttctctgctgcctttccatgtccgtggtgtgtagggaaaatgtcccattttctcagggccctgatagctcctaagctcctatattaactgtgctccagtattaataaatgtgtaggtactaggttttatatttctagataccatttgcactttagcaaatgtactttatgctttaacccataaggtgactaacagagggtgttcaaataatgtgctagaccctttttttaaaattaattctacctactttgttttttaaatttttattttattttactttaagttgtgggatacatgtgcagaatgtgcaggtttattacctaagtatacatgtgccatggtggtttgctgcatctatcaacccgtcatctaggttttaagccccgcatggattaggtatttgtcctaatgctctccttcccctcgctccccacccaccgtcaggccctggtgagtctctgtgtccatgtgttctcattgttcacctcccacttaggagttagaacgtgctatgtttggttttctattcctgtgttagtttgctgaggatgatggcttccagcttcatccatgtccctgcaaaggacatgttctcattcttttctatggctacatagtattccatggtgtatatgtaccacattttctttatccagtctatcactgatgagtatttgggttggttctttgtctttgctattgtaaatagtgctgcagtaaacatatatgtgcatgtatctttatagtagaatgatttacgttcgtttgggtatatacccagtaatggcatggctgggtcaaatggtgtttgtagttctagatctttgaagaattgccacactgtcttccacaatggttgaactaatttacattcctaccaacagtataaaagcattccaatttctccacagcattgccagcatctattgtttcttgactttttaataatcaccattctgactgctgtgagatggtatctcattgtggttttgatttgcatttctctaatgatcagtgacgttgagctttttttgtatgtttgttggctacataaatgtcttcttttgagaagtgtctgttcatatcctactcccactttttatggggttgttttttttcttgtaaattggtttaagttccctgtagattctggatattaaacctttgtcagatgagtagattgcaaaacttttcttcactctgatgatagttttttttgttttgttttgttttgctgtgcagaagctctttagtttaattagatcccatttgtctgttttgcttttgttaccattgcttttggtgttttagtcatgaagtctttgcccatgcctgtgtcctgaatggcattgcctaggttttcttctagggtttttatggttttgggttttacatttaagtctttaatccatcttgagttaatttttgtataagatttaaggaagggattcagtatcagttttcttcacatggctagtgagttttcccagtaccacttattaaatggggaatcctttctccattgcttgtttttgtcaggtttgttgaagatcagatggttgtggatatgtggtgttatttctgagttctctgctctgttccattggtctatatgtcttttttggtacaagtaccatgctgttctggttgctatagccttgtgatatagtttgaacccaggtagcatgatgcctccagctttgttctttttgcttaggattgtcttggctatacagggtcttttatggttccatatgaaatttaaaatagttttttctaattctgtgaagaatgtcaatggtagtttgatgggaagagcatggaatctctaaattactttgggcaatatggccattttcacactattgattcttcctatctatgaggatggaatgttttccattgtttttccatttccatgcactgattttcttgaacagtggtttgcagttctccttgaagaggtccttcatattccttataggctgtattcctaggtattctgttctctttgtagtaattgtgaatcagaggtcattcatgatttggttctctacttgtctattgttggtatataggaatgcttgtgatttttgcacattgattttatattctgaaactttgctgaagttttttatcagcttaaggagttttgggctgagacaatagggttttctaaacatagaatcatgtcaaatcaatcctgggggtggagccaagatgactgaataggaacagctccagtctacagctcccagcatgagcgatgcagaagacaggtgatttctgcatttccaactgaggtaccaggttcatctcactggggagtgccagacagtgggtgcaggacagtgggtgcagcgcactgtgcgtgagctgaagcaggcctcacccaggaagcacaaggggtcagggaattccctttcctagtcaaagaaaggggtgatagacagcacctggaaaatcgagtcactcccaccctaatactgcgcttttccaacaggcttaacaaacagcacaccagattatatcccacacctggctcggagggtcctatgcacatgtagcctcgctcattgctagcacagcagtctgagatcaaactgcaaggcggcagcgaggctgggggaggggcgcccgccattgccgaggcttgagtaggtaaacaaagtggccaggaagctcgaactgggtggagcccaccacagctcaaggaggcctgcctgcctctgtaggttccacctctgggggcagggcacagacaaacaaaaggcagcagtaacctctgcagacttaaatgtcgctgtctgacagctttgaaaagagtagtggttctcccagcacgcagcttgagatctgagaatgggcggactgcctcctcaagtgggtccctgaccactgagtagcctaagtgggaggcatcccccagtaggggcggactgacacctcacacggccgggtactcctctgagacaaaacttccagaggaacaatcaggcagcagcatttgcggttcaccaatatcggctgttctgcagccaccgctgctgatacccaggcaaatagggtctggagtggacctccagcaacctccaacagacctgcagctgagggtcctgactgttagaaggaaagctagcaaacagaaaggacatccacaccaaaaccccatctgtatgtcaccatcatcaaagaccaaaggtagataaaaccacaaagatggggaaaaaacagagcagaaaaaccggaaactctaaaaatcagagcgcctctcctcctccaaaggaacacagctcctcaccagcaatggaacaaagctggacggagaatgactttgacgagttgagagaagaagccttcagaagatcaacctactctgagctaaaggaggaagttcgaaccaatggcaaagaagttaaaaaccttaaaaaaaaaaattagacgaatggctaactagaataaccaatgcagagaagtccttaaaggacctgatggagctgaaaaccatggcacaagaacgatgtgacaaatgcacaagcctcagtagctgatgagatcaactggaagaaagggtatcagtgatggaagatgaaatgaatgaaatgaagagagaagagaagtttagagaaaaaagaataaaaagaaatgaacaaagcctccaagaaatatgggactacgtgaaaagactaaatctacatcagattggtgtacctgaaagtgatggggagaatggaaccaagttggaaaacactctgcaggttattatccaggagaacttccccaatctagcaaggcaggccaacattcaaattcaggaaatacagagaatgccacaaagatactccttgagaagaccaactccaagacacataattttcagtcaccaaagttgaaatgaaggaaaaaatgttaagggcagccagagagaaaggtcgggttacccacaaagggaagcccatcagactaacatctgatctcttggcagaaactctacaagccagaagagagtgggggctcatattcaacattcttaaagaaaagaatttccaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaacttgtaccagccactgcaaaaacatgccaaattgtaaagaccatcaaggctaggaagaaactgcatcaactaacgagcaaaataaccagctaacatcataatgacaggatcagattcacacataacaatattaaccttaaatgtaaatgggttaaatgctccaattaaaagacacagactggcaaattggataaagagtcaagacccatcagtgtgctgtgttcaggaaacccatctcacctgcagagacacatataggctcaaaataaagggatggaggaatatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactatcctaaatatatatgcacccgatacaggagcatccagattcatagagcaagtccttagtgacctgcaaagagacttagactcccacacaataataatgggagactttaacatcccactgtcaacattagacagatcaacgagacagaaagttaacaaggatatccaggaattgaactcagctctgcaccaagtggacctaatagacaactacagaactctccaccccaaatcaacagaatctacattctttttagcaccacacctattccaaaattgaccacgtagttggaagtaaagctctcctcagcaaatgtaaaagaacagaaattataacaaactatctctcagaccacagtgcaatcaaactagaactcaggattaagaaactcactcaaaactgctcaactacatggaaactgaacaacctgctcctgaatgactactggggacataacaaaatgaaggcagaaataaagatgttctttgaaaccaatgagaacaaagacacaatataccagaatctctgggacacattcaaagcagtgtgtagagggaaatttatagcactaaatgcccacaagagaaagcaggaaagatataaaattgacaccataacatcacaattaaaagaactagagaagcaagagcaaacacattcaaaaactagcagaaggcaagaagtaactaagatcagagcagaactgaaggagatagagacacaaaaaacccttcaaaaaatcaatgaatccaggagctggttttttgaaagatcaacaaaattgatagaccactagcaagactaagaagaaaagagagaagaatcaaatagacacaataaaaaatgacaaaggggatatcaccaccaatcccacagaaatacaaactaccatcagagaatactataaacagctctatgcaaataaactagaaaatctagaagaaatggataatttctcgacacatacaccctcccaagactaaaccaggaagaagttgaatctctggatagaccaacaacaggctctgaaattgtggcaataattaatagcttaccaacccaaaaaaagtccaggaccagatggattcacagccgaattctaccagaggtacaaggaggaagtggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaacatcctcaataaaatactggcaaaccaaatccagcagcacgtcaaaaagcttatccaccatgatcaagtgggcttcatccctgggatgcaaggctgtttcaacatacgaaaatcaataaacataatccggcatataaacagaaccaaagacaaaaaacacttgattatctcaatagatgcagaaaaggcctttgacaaaattcaacaacccttcatgctaaaaaccctcaataaattaggtattgatgggacacatctcaaaataataagagctatctatgacaaacccacagccaatgtcatattgaatggacaagaactggaagcattccctttgaaaactggcacaagacagggatgccctctctcaccactcctattcaacgtagtgttggaagttctggccagggcaatcaggcaggagaaggaaataaagggcattcaattaggaaaagaggaagtcaaattgtccctgtttgcagatgacatgattgtatatctagaaaaccccatcgtctcagcccaaaatctccttaagctgataaacaactcagcgaagtcccaggacgcaaaatcaatgtgcaaaaatcagaagcattcttatacaccaacaacagacaaacagagagccaaatcatgagtgaactcccattcacaattgcttcaaagagaataaaattcctaggaatccaacttacaagggatgtgaaggatcccttcaaggagagctacaaaccactgctcaatgaaataaaagaggatacaaacaaatggaagaacattccatgctcatgggtaggaagaatcaatatcgtgaaaatggccatactgccccaggtaatttatagattcaatgtcatccccatcaagctaccaatgactttcttcacagaattggaaaaaactactttaaagttcatatggaaccaaaaaagagcccgcattgccaagtcaatcctaagcgaaaagaacaaagctggaggcatcccactacctgacttcaaactatattacaaggctacagtaaccaaaacagcatggtactggtaccacaacagagatatagaccaatggaacagaacagagctgttagaaataatgctgcatatctacaactatctgatctttgacaaacctgagaaaagcaatgggaaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctacgaaataccattcaggacataggcatgggcaaggacttcatgtctaaaacaccaaaagcaatggcaacaaaagtcaaaattgacagatgggatctaattaaactaaagagcttctgcacagcaaaagaaactatcatcagtgtgaacagacaacctacagaatgggagaaaatttttgcaacctactcatctgacaaagggctaatatgcagaatctataatgaactcaaacaaatttacaagaaaaaaacaaccccatcaaaaagtgggcgaaggatatgaacagacacttctcaaaagaagacatttatgcagccaaaaaacacatgaaaaaatgttcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttgatgggactgtaaactagttcagccattgtggaagtcagtgtggcaattcctcagggatctagaactagaaataccatttgacccagccatcccattactgggtatataaccaaatgactataaatcatgctgctatgaagacacatgcacacacatgtttattgtggcactattcacaatagcaaagacttggaaccaacccaaatgtccaacaatgatagactggattaagaaaatgtggcacatatacactatggaatactatgcagccataaaaaatgatgagttcatgtcctttgtagggacatggatgaagctggaaaccatcattctcagcaaactatcgcaaggacaaaaaactaaacaccacattttctcactcataggtgggaattgaacaatgagaacacatggacacaggaaggggaacatcacacactggggactgttgtggggttgggggaggagggagggttagcattaggagatatacctaatgctaaatgacgagttaaggggagcagcacaccaacatggcacatgtgtacatatgttacaaacctggacgttgtgcacatgtaccctaaaacctaaagtataataataattaaaaaaaaaacatgtcatctgcaaacggagatagtttgacttcctctcttcctatttgaatatcctttatttctttctcttgcctgattgccctaatgagaacttccagtactatgttgagtaggagtggtgagagaaggcatccttgtcttgtgctggttttcaaccagcttttgcccatatagtatgatatcagctatgggtatgtcataaatagctcttattattttgagatatgttccatcaatacctagtttgttgagagtttttaacgtgaagagatgttgagttttatcaaagtccttttctgcatctgttgggataatcatgtggtttttgtgtttatttctgtttatgtgatgaattacatttattgatttgtgtatgttgaaccagccttgcatctcagggatgaagctgacttcatggtggacaagctttttgatgtgctgctggatttgttttgacagtattttattgaggattttcacatcgatgttcatcagggatattggcctgaagttttcttttttgttgtatctctgccaggttttggtatcaggatgatgctggcctcataaaatgagttagggaggagtccctccttttcagttgtttggaatagtttcagaaggaatggtaccagctcctctttgtatctctggtagattttggctgtgaatccatctggtcctgggctttttttttttggttggtaggctattaattactgcctcaatttcagaacttgttattggtctattcagggatttgacttattcctggtttagtcttgggaggatttatgtgtccaggaatttatccgtttcttctagattttctagtttatttgtgtagaggtgtttatggtattctctgctggtagtttgtatttctgtggggtcagtggtgctatcccctttattgttttttttattgtggtctatttgattcttctttattttcttttttattagtatagctagcagtccctctattttgttaattttttcaaaaaaaaaaaacagctcctggattatttgattgtttgaaaggttttttgtctctgtctccttcagttctggtctgatcttagttatttcttgtcttctgctagcttttggattattttgctctgcttctgtagttcttttaattgtgatgttagggtgtcaatctgagatctctccagctttctgataagggcatttagtgctataaatttccctcttaatactactttagctgtttcccagagattctgatacattgtctctttgttctcactggtttcaaataacttgatttctgccttaatttctttatttacccagtagtcattcaagagcaggttgttcaatttccatgtagttgtgtggttttgagtgagtttcttaatcctgatttctaatgtagttgcactgtggtctgagagactgtttgttataatttctgttcttttgcatttgctgagcagtgttttacttccaattatatggtcgactttagaagaagtgccatgtgccactgagaagaatgtatattctgttgatttggaatgaagagttttgtagatgtctattatgtccacttgatccagagctgtgttcaagtcctgaatatccttgttaattttctgttttgttgatctgtctaatactgacagtgggtgttaaagtcttccactattatcgtgtgggagtctcagtctctttgtaggtctctaagaacttgttttatgaatctgggtgctcctgtatttggtgcgtatatatttaggatagtttgcacttcttgttgaattgatccctttaccgttatgtaatgcacttcttggtcttttttcatctttgttggtttaaagtctgttttatcaaagactaggattgcaacccctgctttttctttgctttccatttgcttggtaaattttcctccatccatttattttgagcctgtgtgtgtccctgcatgtgagatgggtctcctgaatagtgcacacccgtgggtcttgactctttatccaatttggcagtccgtgtcttttaattggcacatgtagcccatttacattaaaggttaatattgttatgtggtaatttgatcctgtcatcatgttgctatctggttattttgcacactagttgatgcagtttcttcatagtgtcattggtctttatattgtggtatgtttttgcagtggctggtactggtttttaatttccatatttagtgcttccttgaggagctcttgtaaggcagtcctgtggtgactaaatcccttagcatttgcttatctggaaaggattttgtttctccttcacttatgaggcttagtttgactggatatgaaattctgggttgaaaattcctttctttaagaacgttgaatattggcccccactctcttctggcttgtaggatttctgctgagaaatccactgttagtctgatggacttccctttttaggtgacctgacctttctctgtggcttcccttaacattttttttttttttttcatttcgaccttggagaatctgatgattatgtgtcttgtgttctctgtgtttcctgaatttgcatgttggcctgtcttgctagcttggggaagttctcctggataatatcctgaagtgtgttttccaacttggttccattctctccatctttttcaggtacaccaatcaatcgtaggttcagtctttttaacatagtcccatatttctcagaggttttgttctttccttttcattcttttttctctaatcttgtctgcatgctttatttcagcaaaatggtcttcagattctgatatcctttcttctgcttgatcgattcgactattgattcttgtgtatgcttcacgaagttctggtggtgtgtttttcagctccatcaggtcatttatgttcctctctaaactggttattctggttagcaactcctgtaaccttttattaaaattcttagcttctttgcattgggttagaacatgctcctttagctcagcggagtttgttattacccaccttctgaagcctacttttgtaactcgttcatctcattctctgtccagttctgtgcccttgctggagaagtgttgcagtcattcggaggagaagaggcactctggcatttggaattttcagtgtttttgccctgatttttcctcatcatcatggatttatctaccttttatctttgaggctgatgacctttagatgaggtttttgtatttttgttgttgttgttgttgttgatgttgttattgttgctttgttagtttttcttccaacaggcaaggcccctcttctgcagatctgcttcagtttgctgggtatcctctccagaccctgttcacctgggtgtcaccagtggaggctacagaaaagcaaagattgccacctgctccttcctgtggaagcttcgtcccagagagtcactggcttgatgccagccagagctctcctgtatgaggtgtctgtcagccccttttgggaggtctttcccagtcaggaggcatggggtcaggaatccacttgaggaggcatctgttccttagcagagctaatgtgctgtgctgggagaatcccccttgtcaggatcagctgctcttttcagagccagcaggcaggaaagattaagtcctttgaagctgtgacagcacccatccctccccccgggtgctctgtcccagggagatgagaattctgtctgtaagcccctgactggagctgctggatttgctgcagagatgccctgccccgtgaggaagaatctagagaaacattctggccacagctgcttcgctgtgctgtggtgaattctgctcagtccaaacctctcaatctccttagcactatcagggggaaaccacctactagagccacagtaatggaggtcgcctctcccccgaccaaacttgaccatcccagtccgactccagactgttgtgctggcagcgggaatttcaagccagtggttcttagctcactgggctctgtgggagtgggacttgctgagcgagaccacttggctccctggcttcagccccctttccaggggtgtggatggttttcctgtctcacgggagttccaggcactgccggagtatgaaagacttctgcagctcagtgcctgcccaaacagtggtctatttttgtgcttgaaacccagggccctggtggtgtagatgcacaagggaatctactgatctgtggattgcaaaaatccatgagaaaagtatagtacccgggtaggtgggacagtctctcacggcttcccttggctgcgggagggaggtcaccgggctccttgcacttcccagatgaagtgacgcctcaccctgcttctgcttgctctccatagatcacacccactgcctaaccagtcccaatgggatgaaatgggtaccttagttcggaatgcagaaatcacctgccttctgtgttggtcttgctgggagcagcagactagagctgcttagctgtttctatttggtcattgtggcccccactatgctagagtgttagggagaatattttgggatagagaagttgttctggttgcttagtgctactgaataaagtacctcctatcccaagtagtagcttcaaacagcaattttattttgttcataatgttgcaggccaggaatttggggagtgcttgcctgggtggttcctctctgatccatgggaacttagctggagtggccagagcatctacttctgtcatattctgtctgtcagagcagtcacaaggctttcccagataagacaggggaggggaactggccctatcctctgaggggatgcagcaagatctcaccacaggagtctgtgggatgggcaatgctgtgactacctttagaaaatacggttcacataggaggtttccaggcagatcagatgctcatgtggaggaatctgtaaccccagtccaaagaattatgatgcagaaaacatgtggcacaagaggccaaaataatatcttccatctgcaccccacagaggaaaggaagttgctattaagaagaccaagaaaatccgtgtctaccctcactcacatcctacaccccctaactcctaaactggttcttgtaccccattccccaaacttcctgtacccttatctgctaaacttcttgtactcatctacaggtactgaaaatttctctaacatatgtagaaaacttttccttccaatgcaaaatataaaacttaaaattgtcatactaagccctgcacaagcttgacagcaggggctctccggagatttagttgtgagaacaggaaggcagcatgagccccagggttctgctgcagcatcaggggaggggaggagaggaggcactctggggagagcgacggtcaggaaggagcttagccatctccatctcacaggggaacccaggggcactgctagactggaatgtctctactgactccttggtttttcccattcctgacactgtcattaactgactcctactggagacccctgtctgccacatgggcctcagtattgcaggtgtttgtgagctggaccccggagcatcaccctttaagaacttggctaggatggcaggttggggataaagctgccaaggagcatttttatttctgcatgttaaaacagcccttgcctggccacctgggttggagggtttgtaattttgtctcagccactgcccatcagctgcaagggtgctattaaaggcaatcttggtgttactgcagtgaaatgtcagctgagagctgcatttctcagctaacttggagctggggcacccatatcctcttgctcgagtgtggtatgaaattgaaactgggctggggctggattctgtcctccagatgagctgcttttgaaaggaaaagaatctctgtaaaacctgggaatcaatctgactggtgatgctccatacaggtggccaaccctcaggcttccctgtggatcatcagcttggtggcttctctgtggtggccctcttgccccattgacctgcctctcatcttgcccaggttccctttccctctgggaactgaggccaggtaaggagacctgggctttttcttcttattattgttattatttttttgagatggagtcttgctctgtcaaccaggctggagtgcagtggcacaatctcggctcactgcaacctccgcctctcagcttcaagtgattctctcaactcagcctccccagtagccgaaattataggtatgtgtcaccacgctcagctaatttttgtatttttagtagagacaggatttcgccatgttagccaggctgttatcgaactcctgacctcagatgatccacccgcctcagcctcccaaagtgctgagattacaggtgggagccaccacgcctggccagcatggactttttctataacaagcctgagcctgggctgggatcataaactgtctggaaaataaaaatcatatcctgaattgacagggcaaaagaaacacattttggatatttcacagttttctgtcatccataccgctctctccttcctcattgacaactgaaaagtgaaggaaaatggcacaggttggccaggtctgtggactgaaaacccaggaagcaggggaaagagaagtgtgtgtaacccacagaggagggtaggatgatttgtggtggggtgcgggcagaaggcttgcactttctgcctcattgattgccacggccccctgtgcaggatacagaggcagttggacaagccttatgcatcctgggctttggtgacatcagcaaagtagagatcatagtcatgtcttcctcatagggcagtgtcttagctgttcaggctattcaaacagcataacatagaccaggtgccttaaaaacaacagaaatttatttctcacagtcctggaggctgggaagtctgagatcagggtgccagcaggtttggtgtctgctgagggacacaattcatagatggcatcttgctatgtcctcacatggtggtggagggggcaaggtagctcactggggcctcttctataagggcactaatcccattcatgaagctctgctctcaggacctaatcaactccctaaggcaccacttcctaataccattgaattgggggttaagtttcaatatatgaattttgggggcacattccatctatagcaggtggacaggaagattccatgaaacaatacatgcaaagcaccaaaaatagggcctggaatatagaaaacactcagtaaatgtttgctgtcactacctctattactatagaggaataaatgaaggcaaaatgaaatagtgaggtgacaaggtaaaagggaaagcctgccatgtcagatggccattggcaagcttggcttctgatccccactctaccagtaactattctgtgaccttgcacaaactctttaacttctctgagccttggattcccctcctaccaactaagaagattagatcagttagtttctaaggccccttctgctagaaaatatattatgagcctgctatgaaaaatgcaaggtcaaggagaacctcctatcatagacctggaaggggaaggaggaaatatgtgcatggaagggttgtgggcacagaggctacaaagctcagcatttgttaatacagggactggtgagtgctgcacagaggctagcctggtgtcctttccttcacatcctgcgtagccattgttctctataataacatcaaaaaatcactagaaacatcaagctcccagttgcctcacttaacagaagcttgggttatgggtacagatggttcttcaacatccattctcctctccttctctgtggcagtagggtcccctttatctgagctgggcacaagactacccagttagagttggtgcttcccaacctcccttgccactcagtaaggtaggtgtctgagttccagccagttgtgtgcagctcagggtcccattcttacaaagatgctgcttgccttcttcctaatcattctaacttcccagggctggaacccagtatgggggtgggtgttcagtttccattgtgtgcatgagataatgatgcaggactttttgctccttaactcagctaggtttgcattcttgtctcacgaccaggaagaattaggcaagtggacattaaagagtgagtggagtagaatttattaagcaaaaggagagctctcagcaaagagaagtgtcctgaaagcaggtttctggttgcccctttcacagttgaataccagggattaaggcgtgaattcctggcagctccactccatccttccagtgtgctttcaggcccttagactgagacactccatattgatttacttcccttaccgtgtatgtgttaaggaatggaattttccactgtgggcatgtttaggcaagtcccctatgcaagttcccttatctgtgcaaaacatctgatgtaagcacttgtggggcaggtcagaggttctccagggtcgcttcccttactatcttcctaaagcaagctggctaactcctttcaataacatactaaggataggaaacctgggtgatcactggaacagtgccactttaacccttaggtcacctgcctacttggacttttcatgagagatatagaaacctatttgtttaagtgcgtgttatctgggttgggttaggtcctagcagccacattagtattatcataaacacaggaatgatgggggttagaaagtggggaagaggaatttgtaatggatctttgttactgaactgaactggggtctcctcacccagctcagtaaagccagacactgacactaagatttgcagcaggagaaaagagcatttattgcagggcaccaagggaggagaataggcagctaatgtttcacacctgaactccccagtggcatgcaagcaagggcttttcaaggcaggggtacatttcaggaaagcagaaattgcagacaaaattataaaccaattacacagaggttatacattgttttggcccatggcatgactttctccagacccctcaggaagaaatttagaacagagaatggcagccagagttcagtcgtcagtttccccttatctgagcattaagtgatagtggtcagcactttccatcttgtggggatttctaaaaacaactcacaacttgagaacatatgttaagatgtcatcttttagtttctatagggaagcaaaacaccttgtgactctggcttgcctgggagactgttgttactatcttcctgcttatcaggttgcttgtttgcttttcaaggctacctaggtgcttggaatttgccttgaagggactcaaggtttttctttatctccatgcttaggaggccaggcaggccatcttgagacaaactagtacttcaaatgtggtgtggtccaaagtctgggttctagtccctgatcaatcagcccaggccagctggattgggggatgtggtggtcatctcagctctccacatgcttgcccccttgatgcaggatttttctcagccactttgccagctggagacccccagatgtccatgcccctgcccaggcctcactctgccccaggcttgctgcaggaggtactccacccacttggcctgctgggccatgcctggcttgcacaccagcccagctcccacacttaccatgggatctgcactcatcctgcagttgggctgggtgtgcaccagtccgccagcattacagcttgtatctgtgttcagtggtccctgagttcttgtctcatgtccaagaagaatgaggttatactgacaatccaaagggtgagaagggcagaggacagaccacctgaagttgggtggtctgtctccccgtgtggctgggtccagggcttttatgggctcagaatgggaagtgcatgctgattggtttgtgagtatgtgaaagaggctaaaacaaaggcaccactcaaaggtgggcatgacagtgtaaaaaaccaattagggaatggtagatatatgtaaaataggtgaagcgtggggaacaatcagcggaaagtacacccaaggggaaaagaggttcttaatcaggtctgtggatttatccgagacttgtagcttggctttcaggttttaaactgtctttggcttgaaagttgggtttcagtggggacccacccctatctgcctaggcatttgtctgcctcctgccactatcaccctcctctgtgccatggcagggcctggtctccaggagtgatattctgtgactccctaactttggactgctctaggttctacctcagagtcacttgttaaagggacagatcttcactcactttccagagagggtgagaaattagccaggcagtccatgtgaggcagctgctttataaacattgagcagacatcatttgtaattgggaaggtgatgtgatttcagggtccccatccataaactctctcatgttctattgtgcaccatggtgcttgaacacactagtagagttttattcctggatttagtcattctagtcttcagatgttctagttaaaaaataaatcctacattcactcaccaaacacttactaatgctaagagtggctatatctgtccctgttccagatccagatgctgaagacccagagttgaataacagtcagattgtcttaaaaccatcttataatccacgatgtgtgatgggcgtgtgtgtgtgtgtgtgtgtgtgtgtgtgttaaagcacctgatgatgacaattcttctccactttcaatgcaccaaagaatcaactggagatcttgctaaaaggcagaatcagatcagtcagtctgggggcaggcctgggattctgcatttctaacaagctcccaggtgatgcagataaactggtccaagactaagtttgcgtaacaagagacaataagagtctgatcactgctgtcaactagtgtggaggacccacataggagagaggacatgattgagttgtcctggtcagaggctagcagacgaagcgaagtttacccaagaggtttcacattcagtctagacctctgaggatgaataggccatcagcatccataactggcatgaagaatagtttatcaggcttcttaatgtatttttccatcagcattaatgagacttagccaagagacaattttggttaagagttggtgagtggagaaaaatgggattcatttataacaacagttctcaaacttgagtgtgcctcagaatcactcccagggcttgttcaacacagattacgggtccccactctagagttgtaagtcagtaggagtgggctggggcccaagaatttgcatttctaacaagcccccagtgaattttaagaaccactggtttataacaagaggccccacagggcacagcaagaggggagcctggctatagtagggacaagaactggacagatcgggggataggcagaggaactctgagaaagaaatatgtgggcaaggttgctggaaggggttgggttaagactaatcctgagaccgtaagttgtagtccagcctagctgatatggacaagatattaagaactgactaatgaattgtaagttgcctaagagaaggggcctggggcttgtctacccagtattcctatcaccagcagagtgaagatgtggtcattccaaccaaaattactttctcccttccctcccctctttctgattatgccacattctaggagtctgcctataaaatagaaaactcggtccagcccagtcagctctcagtggacgttggcaccctggggattccttgacagttccggggcctctgtggcttgggcagagagagcctccatctgtggtggcatttgagagctgttgttctccaggatgcagtagctccacagcaaaaaaaaaaaaaaaaaaaaaaaaaagaggcatcatatgcaaatatcaaatgaaggggagggaaggaggaaagggctggctgacattttggctctgcccctagatcctctgagaagagaaaccactcgtgcctgaattaatgttaattcaagggggtattttcaaaaagtggtccttggaggagcaagatgctgtgtttcctattttccgttgcctccagcaagccgcaccgacagagggtcaatggggttactgtatgaggaagcccactaattgcattataaggaatgttttgcccattagctcagatggaatggtctcctaacagagtcctttgaggggagtgatatttcaggtgggggatggaggaaaaggaattgataagtaattgaaatttgcaaatggcatttccctgggccctagacaaaaatgggttccatacatccagcagggggcagcaatgcacgtacattaattccggtcttgtgaatcaggagcttggcgagatctcagaaattgcaaagcagtaaggatgcctggggaggtttatagacaatttccaggcccggcaaagctgggactgtcacacccaccatttccccaacagtcacaccttttatttttctcaatatactgagaaaataaatgtttaggtctgatggtttttaattctagaaattttctttaatctttcggctgctttgtgtaatttagaatttctgcagcctgactgaaaattataagtaaactaggattaggaagtcagctttattaataagatagttcagctaatagacattttaaaattgtaatgcaatctatctccctccctgagttgaaattttgctagagctgtaactgataggacacccacacaccaagttgggtaacttatttgctgatccattttaaagtggaggaaaagaggctccaaaaatataaataaagataaaagtctcaaagaagtatcagattttcctgaattaggcacagaaaagacctactagtttgtccattcctaaggctgtttaggaatgtggcccataatatattttctcagtaatttgtcaaatttgcttgtaaatgacttttatgatagatggctttgcctgctttactgggctggaaatttctgcagcccagcacacttctccttcaggaagcttcttgcatcttgcataatgtttctcccagccaccctccccgcttacgccccttcccaaggttaatttagtcctgttgttcttaaatgaactactctaaatcatcctcctccccttccctgtctttctcctcactgtttaaacctttcaaggatgtaatagtctggcaaatatttcaatcatcatgtctccttttcagctgcccaattcaattccatttggtgctgctcgtgctgaagtgcaatttttcacagcattgtttttagtttaaataacatacagtgcactattgctaaaggtcttctggaacattccacttgggggtcttacccttaaataatattttgatgggaaactaactcaacttttcataggaagaaatgctatttgctcccagcactaattggctgtaaatttagctaaaagtccatctacgctggcagttagaccatcttcctgtgcccatgtggtaccctgtattagatgtctaatggacagacttagtgaataagtatgtatctgtaagtgcaccatttagaaaacaatcaagtgaaaggaatttaactctgctaagccagcaaatgtaatttttctcatttcttgccccttcttgccacgtggcagctcctcaatttaccagctctatgcccttgcatgtattactcaacatttctgagtctcagtttcctcaactgcaaaatagggaaagcaatatctgctttctaggttttgttgtagggatcaaataattatgtacagcatttggtaaaacataagtccccaagaaatgcaactttttgccattattattatcactactcttatcattatgcagtctaaattctatgcctgggttatctttcagagttcctgactgcctatacattcacattgttcaacaaatgttacttagggaaaccgtctctgaccccctggaattggccaggttcccctgtgattcactgtcacagatacgtgtgtgtgtatgtgtatatgtattcttatattattaccctcaaattaaatgctcccttcttcataaattcagagcagctaatatcctctcttctctccttaatggtgtgtctaacataccttcatatcctaggcttgactaggaacttctcataggcaggagcagagccttgcctttcaatggagcctggattgtcacatagaaatgagcacatagaggtctgtggtgtgtacttgtgagactatcagactgtaatatctttgaattcagggaaaaggctaattcaccttcagttcccagagcataccacaccccaagcctgtacatggtaggcattcgagggaggtctactgtgtcgattaaggctgtgcattggtcttccaaactttgctcaccatatacaggtttccttcagagtcccagtgtccatattactgtttaacacgactgaaaaggaacaaaacgaaatccccaccttcaccctctcactttgactgtgggtgatttctgtaattaagagcttcaggaggtcgggcacggtggctcacgcctgtaatcccagcactttgggagacagaggcgggtgtatcacgaggtcaggagattgagaccatcctggctaacatggtgaaaccccaactctactaaaaatacaaaaaattagccagacgtggtggtgcgcacctgtagtcccagctactcgggaggctgaggcaggagaatcgcttgaacccaggaggcggaggttgcagtgagccgagattgtgccactgcattctaatccggtgacagagcacgactccgtctcaaaaaaaaaagagcttcagatgactttctaagatacactccctaagaatctcatataacgaatggcctagaacatgacttctttattgttaacctatgttgatgccaagagatcagtgtgtctttttgtgatgctcataaacaacctattaaataatccgttttccatttttaaggaggacttaggtgcatgtgcatgagtctgtgtgagttggtgggagaccaaagggagacagagtattctgaaagcccaccgaattattcagctctattttctggcccagaattcaccagatagcacaaaacaagctaaatcatggcatgataaaacactgcagcccggacaatgaatatgcaaatagcataacagagttaagtactgagagagccatctattgtagatagtttagcttccctttagtgaaagatcaaggacagaaacacaaaaagatcatgctaattttaaaaagagaaaatagatgctagctaacgtgaaaaggatgaatataaggaggcgttggatcagtccccccagggctcagcagttctggaggatggcaagcccgagtctttggatacaaggaacagcgcgatacaacggaggtacttgcctcttggaaaacacacttgcactctgtgttgcatctgtggtttccatggtatgaagctgccactgtgtttgttccaatgcactttgaaaagacagggcacatttatgagcaaaggcatatggctttgtcctttcaagcttatccaaggctttagaatgtcaactgtagtggctggaaagcagccagcaaattaggaggctacagaagaatttcgtgagcttttaaaataatttatttcagtttatcgtttacatagaatgtcagatctgaaggggaccccaggagttatccagtctaacttcatattataagtgataaaatgaggtccagcaaaaagaagtgatgttactcatagcgagagtttgaatgtgctgttcctgattcatacattagtgattattccattatacctagctgtatttctgtccagactatttttataatgctgattaagctgggctgttttggtgaattttaacatttcccatagatttttaccatgtgtaattttggaaagggggctttgttaaagtattagaagacctactatagtagtttcttgtggtttaggtggaggaagagcactgatggcattttctgttgcagtaagtttgttggttgtaatatagtttttggttacaaggagcagaaacctgaccacagctgtttgaaagaatataagttcatttttccactacaagaattctggaagtaggagagtttggctttggttcagcagctcaacgatgttagagttgatgtctgattatctcagcctttgcctcagtcataagacaactgccacagtgccagccatcatgtctgcatttgatgcaggaggaaagagaaagagggggagcaaactgcatcttccgtgttattgggggaaaaaaaaactttcccagatatgtccaagaagtcttctgtttagatctcactagccagaattggccatgatgcaaagaagttgaaaaaaggatgtcccttataggcttagattagtcatgacccttcccccagggcttgacacataatcaggagcttgtaatgctgaggaagaagagggcaataactgagggctccatatcaccctaaaactgtccacattcccatttgtatgtaatatgtttggagtacaagcttgatgcaaggatgggcagtggaaggtttttggtgtctgattctgtcatctctttatacctttagtggaagattatttcccaaccaaaggcttatctgaggataacaaaacaattccattgccagacatttatagagcccaacctgtggaaacaataaatgcctgaaacagtttacctgcactatatttcaacttctgaaatgtagatcgagaggataaattttatgaaaagttcactaaaagtaaatattgacaagtggttaaatctcataaaagacataattttaaaatgctgcttgcacctatagttctgttaagtcaaacggcaaaacacaactctgtgctcggttctctgctaggcagttgggatccatcactgagaaaataagaaaaaacatttggggcacaggacttggggatgtattagtcagggtcctccagagaaatagcaccaataggatgtgtggacagtcacccctttgtaactgtgggttccacatctgtggattcaaccaacagaatggcagataaaaaatatttggaaaaaaatatatctatactgaatatgtacagacttttctggctattattccttgacacagtatggcataacaatatttacatagtatttacattgttttaggtatttgatatattaatagtttggatatatgtccttaccaaatctcatgttgaattgtaatccccagtgttagaggtgggacctggtcggaggtgtttgggtcatgggggcggatccctcatggcttgctgctgtcctcgtgatagtgagttctctcaagatcttgttgtttaagtgtgcagcaccaccccaactctcttgctctcactctgccttgtgagatgcctgttccaccttctccttctgtcatgactggaagcttcctgaggcctccctagaagccaagcagatgccagctctatgcttactgtacagcctacagaacaatgagccaattaaacctgttttctttataaactacccagtctcaggtattcttcatagcaatgcaacaacagcctaacacataataatctagagattatttaaaatatacaggaggatgtgtgtatgttatatgcaaatgctataccattttatatctggaagttcggcatccttgaattttgtaaatattggcaagcctttaagtctcataaaagatgtaattttaaaatgctccctgtgcctagagttctgttaagtcaaaccacagtagcctaccaatgtgtatatatgtgtgtgtgtgtgtgtgtgtgtatgtatatatatacatatatatatatacacacatatatatatacatatatatacacatatatatatacacacatatatatatacacacacatatatatacacacacacacacacatatatatatttttttttttggaaacagagtctcactctgttgcccaggctggagtgcagtggttccctgcaacctccacctcccaggttcaagcaattctcatgcctcagcctcccaagtagattggattacaggtgtgcaccaccatgcctggctaatttttgtatttttagtagagatggggttttgccatgttggctaggctggtctcaaactcctgacctcaactatgcctcccaaagtgctgggattacaggcatgagccaccacgcccagccacatatctatgtatattgatataccttggtatcctcgggaggtcctggaaccaatccccctcccctcacggatactgtatatatacacacatatgtatatatgtgtgtgtgtgtgtgtgtgtgtatgtatatgtgtatatatatatgtatatatgtatatatgtgtgtatatatatagtgtatatatacgtatatatatgtacacacacaaatatatacatatatatatataccattagatgtatgctgaaagattcaaaaagtcttgaatgagcatctactacatgtcaagtgctatgtaaagcagggagagaatggggagtgacacagtccctcctcgagggacacaaccactggatgagatagacaagcatagagaccctcacaggctgaatggtggctgccctgagtgagcacagagctcacggggtgtgcaggggcaggcacggctgtcctcactgagttggctgccctctggggtaggcccagtatgaggtcccaagagctggactgacttagctcaggttcccaggcctagaacctgaacccagaccacctggcttgtcatcctgccttagcagaaggcctctctgaaacccacaagcagattcttgacccagtgagcatgagtcctttactctgcctgaaaaaaacaccaccaggtaacatcaggggctggtggtccctgatggcagtgcaatacattggccacagaggacatgggtattgtggaatcagaagatgcttgttgccacagcaaagaagagcatgatttcctggaaggcaacagaccccatggagatgaggctgctgtagcctctacctccctcattcatgctgcagaagtatagccttcctctaacagttgagggtctgaaacttctctgctttcctcagcccttgggagaaagcctaatgatccaaagcaagctgaatggagtcagtagacatggaaaactgggagccgtggtggccttcagagaagagaaccgatggctggctagagagcctggcttctgtaccttttggattttgtacaatgaacctgcattaactttaggtatgatgttaggcaagctgatagcaaaggcttttctgagtaaagtgagagtccctgaaggccatgtgctagattacaaacatcatgggctcagagtcaacagtcacagctctgccacttattatttgggtcatctcacttatctgcttcaaactgcagtttcacaccaggaaaatgggatgctcatgagtttgtggtaaggaatgaatgaggggatttatgtagatagttgaagccagaagttggtcttgtctgttggccttgagacacaggtaggctgaaggccatcactgatgtgcagccctgggtccccagctgatagctacagtgacctgccccatcagcaacaagcacttcctattcactctgctcaaaaagccaaggaagtatgtcatatatttggagagggggcagattaaaatgctggcagggcttaaagggggagggaaaacttgactttgcagcacggctcatttctcaaaggatctgcacaagcattttctccccctagatatgcgctatctcttaaatcaacaataagtaatgctttacaaactttttagtgcacacatctctcccacataaacagtaagcttaattctggaaaagacatactttcatacgtgtttgtaccgttcaaaccccacacatggctgccacattcacttccactttcaaccatttttttttttttcctgagatggagtcttgctctgtcacccaggctggagtgcagtggcacaatcttagctcactgcaacatccacctcccaggttcaagcgattctcctgcctcagcctcccgagtagctgggactacaggtgcgtgccaccatgcccggctaattttttgtatttttagtagagacggggtttaccatgttagccaggatggtcttgatctcctgaccttgtgatccacctgcctaagcttcccaaagtgctgggattacaggtgtgagcctggcctcaaccacttttaacacagaataggttggtaatctattgctgtgaaacaaattacccaaaacctagtgccttaactctaacagtttcttttggtcaggaatgcagaaggggcttggttggcctgctgtgtttcagggtctttcgtgaggttgcagtcagaagtcagtgtgggccgcagtcatccaaaggctttcctggggctggagggtctgcttccaagatggtgcactcacgcaactggcaagttggtgctggggctactggtgtctctgttttattctgggtagggctacttgagtatcttcatactatggtggctgggtccctcaaagcaagtacccccagaaaccaatggaagctttgatgcctttgatgattcagcttcggaagtcactcattagcatttctgagtcctctattggtcatatagaccaccagtgattcaatgtgggaggagattaaataaaggcgtgaataccagggctagccctggaggccaacttcaaggctgactatgacacagagctgagacacaaaggtacttagttaagcacctgataatttgttgatgacatgattgtgcataatgtgaatataacatatacatggtaagaggtgaaagtgtgtttgttttacttttaggggagatgttactcaagtatcccaaacttgagtgttcattagaactacctggagggcttatggaaacataaattgctgggccccaaccctagagttcctgattcagcagatctagggtgaaatgggagaatttgtgcttctaacaagttctcacaggataatgatgctgctggtccagggtcgtgctttgagaactactgccctaattgatatagagacctagtggtccttcaagaaaatttgcttcaatgcaaatacatccttggcctcttatagctgagtgcccaaactgtcaaattcattaggcatatcatttttaatttgacgttttccaaatggcacagagtttatgtaaatgtacgaatcagagagacagtatatggacagcctaagtagtggtatgctggcaaactggctctcctcccaaaataaaaagctttgatttgtaacttttgccagtttccatagtgtaaatgctcccaccatggccaattaccaatagttaactagctcacaaaaattcctatttcacagttgactctgtagctggtacatgctggccccagtacaccattggctctaagcaagttctttccctgcacatatgaatcagagaaagtagtggcctatgtgggggttggggatcactgggtgattctaattgctagtaccttgtgcaccaaacaaaggcggtcaaatgccaggtctgattttcttcctacctggagtgtttgagtctttgaggtagctaaagtgataggatgtgattatgcatacaatgctatgtggtgcaggcacatctaaaatggacttttcaaatcctccccctccacacagtctccttaatctacccccacttggacaattctactgaccgctccaggccttctgtcctaattaagcacaacctcatagacactcctcctcaaaggcctctctggctttccttccctttgaagacaccaaggctcctttccttagggtaggtgacaggaaatactttactgaaatccattctttgagctgccaagatgcccagtgagggtataatgtctgagtgcctgtagaaattgggtagaacatttatttggcaattcaccttgtagagggctgtttatcacattgaactgttgtttaaaccttaacttatggccaggtatggtggctcatgcctgtaatcctggcactttgggaggccaagggggggggcagatcacttgaggtcaagagttcgagaccagcctggccaacatggtgaaaccccatctctactaaaaatacaaaaattagctgggcatattggtgggcacctgtaatcccagctgcttggaaggctgaggcaggagaatcacttgaacccaggaggggaagttggagtgaaccaagatcgcaccattgcactccagcctgggcaacagaatgagactccatctcaaaaaacccccaaatccttaacttgtaggattttttagtgtgttccctcacagcgtctaccatggggttttggacaaaataagcactaagcatttcatgagttccaactttgaattctttctcttgcagaaaacactggcattttaacagagagcttcaggtgccttaatgccagagagtgggtcatttgggaattctctcatgggattcaattaccataagagaaaagtggaataaaatgttttggtagtgtaagattagctgaaagaaaggatgagagagagagagagagagagagagagacccaaggtcaggcaagtaagtttattaacctgccaggctgctccaccgcagtcagaggaggcagccctgagcttaaaaaatgaggggtttatatgggggagagagaccctagggttgtcggttaactttaccacatatcttctcgtgactggcttacaatatagtatcttgtgaaaacatgaatttacaagaggatgtaacttaggtttatccgcgtttctcgtgacctcccccatgccgcccgggggggctgtaatcagggttcactcggcaagtctggtgaccttgctgtggcacctagataagggttcagggatgcagctgcagagtattcagggtaagggtcagctgcactgagtggtggtggtggtggggtgggggtggtcctggggcagcttgtccctaacagctaggaaagccttttagggcttcttttttgttatataaaggatacgttctcagaaaaatgggactcatgctgatccagtgcaataataacaacaaaagcccagcatttgaggtaggcagaatgtgacccctacagaagcgtcatcctccttagcttctctagctctgacattctgttaagtttcttagtctctctaagcctcagttacttggtctgtaaaatgagactagcaatacctgctctgttgtctcttgtgaggaggaaatgagaatgtgtgaaaagtgctagaatggagcctcatgggggaggctctcccaccccatgtcctgatttggacaaggaatcccacacacctcatccagatacacagaggctcatgactgagtctcttgacaaattattttttgagggtgcatacttttttgctgtgaatttccaaatgtttgcatttctaaggccacatttgtgacacagagatcagatcctttctgacacaatgtaactggcaggtcctaatgagctgggggcaccgggaagcattttaagtggtagcatttctggaaatattgagatgaggtcgggggaaagaagctttttcttcagggcctaacctgattaacaagacgatgcacttgagatacatgaaggtggatttctctgcttccagaagctcctgggttctggaaggttatttttatagtatggcaagtaataagcattagtgaccagccatgaatcccagatttggaaaggacgactcctaagacaggggcagacctggaaggaggagataaacattgaataggtgctcagctcaacaggctgcccacagtttacacaagcttcttggctcaatgtatctgtgctagggaaaaaagctcctcttcagttgctccagaagcacatttattaagcactaactgtgtgttaagccccaaaagaaatagaaaaaaggcaaaggacctgattttcatatctaggcatttacagagtagattatgaaaaaggtcatagatagttgtaattatttaactctccttgctataatagaaaatggcgttcatgctcggaatcaaatagagagggttttcatgcttggaaaattcagtaattaataaacttccaatgttttgaaattcatttctttgtagccacttaggaaaagaactgaccgaggttgggatccaggatcggaactttatgtggcatgtaaaataatttgaaagagtgagatatggctttgtaaatttttgtagaaaacaacaaacctgatgatttcccagatttggggggtaacatcaggcacatggagggtgaggtgtttggggcttgaattacagcattttcttttaaacaggcgtgactttccatgcgtagaaaatggtctcagggcttggattaggacgtagagctggaaatcagggagcccgagtttcattcagtgaacacataaacaccttactgagcactgacttcacgtgtcagtgctgaggataagaaaagcaacagcgtggcgccctgatgaagttgatggaagcacgctcagggcagcaaacagctctcccggccaggtcttgggagtagtcagagaggagctaacattgacacagtcttaaagaggagtcgaattggctagaaagaatgaggccagtgttccaagcagagtgaacagcatttcgcagcgtagtcagaaggccacaaatactgtcgttggaaaaggcaagagcattggttctccaagggtaacatgtgttccaatcacctggggacctgtgacatgcaggttctcattcaagagttctgaatgagacttgagagagtacatttctaacaagttcctgggtgatgccatgctgctgcctttagcccacttggtgtggagaggctgtggacatggagcatggagctaggagtaaaaatgggggctgggtggaggaaggggaggatgagggcttgtcacctgggctgatgattgcaccctggcacacttcagctgtactgcatactggtaatagcatccatggtgctcccagcctccaatgggctctgggagctgtctgcatccctcagccagcttagctctctttcccaatccaaatagcagcaacatcctcaacctccaaccgcccacctgccattataaaattcttccctccacccaagcctaagctttctgccagggtctggctgggtttcctcttccttttggcctcccatgggccctcaatacattcatcaccccttctcgatagctcccaccttttgcctttcccacctctttttcctcaaccataaacctgtttggcaccctcctgtcctacagccactgtgctgggaaactggccctgaacctgggtccccttccactgctctccagtctctccccatcctcacaccctgattgcatcgaagaacaaactcacacttgtagtttctctctccttcgtctcatctgttctatgtaatctatcactaccaccattctgccttccccgctctactgaaatggctcatctggagttaacactggccttccgatttcccagtccaggaatttcaggcccagtccagcttgtcctccagaacactttacagtgttgatcaccagtgcccagtctccctatagctctccagattctctttggccccttctcagcctcttttcctggttcctcttcctccatccagtcctcaccaggtaacatttcccagcttctcctctctccaaacatcctgcgtgggcagattgcccaagcctgggaagtgagccactctttctatgctgttgactcaggaactcagcctccttttgcccatctttctgtctattggtcatatttatgtaggtacctcacattttgtttttttttgttttgttttgttttttgctttttttttttgagatggaatctcactctgttgcccaggctggagtgtgtagtggcgccatctctactcattgcaacctctgcctccaaggctcaagtgattcttctgcctctgcttcccgagtagctgggactacaggaacgtgccaccatgcctggctaaattttgtattttttttttcagtagagaaggggtttcaccatattggccaggctgttctccaactcctgacctcatgatccacccgcctcagactcacaaagtactggaattacaggcatgagccactgcacctggcccagtgcctcacattttcaaaacagattccttcttttctctcctaaacctgcttttcctcctgggtcccactccaggtgaatcatacccctaccatttctcttctacagaaatcaaactagggagttcacttgactcctctcccagcctcacctgccatcagccatggtcctggctcctgccccccattaactgctgccttagtgtaggagatgacttcatttcattactcagattactgcctttgtcgtcacctgacctctctgcaaggagctgtggctttcaactttggccacacattagaatcagttggataatgtgatagggttctccagagaaataaaatcattgaatatgagtgtacacacacacacacacacacacacacacacacacacacagataaggaattggcttacatgatgatggaggctaaatgccaaaatctgcagttggcaagctggatacccaggagagcaaagggtatagttccggtccaagtccaaaggcctgagaaccacgaaagctgacggtataagttccagacaaacctggtaggttcaagacccaggaagactcaatgtttcagtccaagtctaaaggccagaaaaggtcaatgtccccctcaagcattcaggcaggaggagctccctcttactccaacttttcattccatttaggctttcagctgattggaccaggcccacccacattagggacaactgtcagctttactaggcctacctattcaaatgttaatctcaacaagaaataccctcgcagacacactcagaatatttggccaaatatctaggcaccccagtccagtcaagttaacccagaatattaactatcacagagaacttttagcaacctgatgtccaggtcacaccccaatctcattgcattcaaatttctgagggtgaggcccaggcatccatttttttttttaaggctctccatatgattccatcgtgcatccaaggttaagagccactgctttcatctcttctccctcagactgattcttcacactgccaccaaagtggttttcttaaaactcaaattggattatatttgatcccctgttcaaaagctttcaatgactttccatcatatttgggaaaattctttggcatgttatacaagcctttttgcatgttacacaaggcccttcatgattggccctgcctaattcttcagcctcattccgtgtgggtgcatcaggacatcgtactcaggctgttctgattcacctctcaggatttcttacggttctctgcatttgcatggactcatccttcagtccagaatgcaatctgtccccagcctattctccttcgtctttaagatcctattttgtcacttacagaaagccttctgagacactctcaagactaggttaaatattccttctttggataccctagcacccagtgctgtcaccaccaagagggagccactggtagatagtagtagatagtaatagatagcaggggttatctactatttacaaagcagcaaaacccagcacacagtatgcactcatgtagcacacctgcatgaatgaaggtatccacctcttcctacatctctaacttcagaacaagctcatgcagcaacaccgagaaagagttgaaagttcaatgagttgttagggcaaaagacttaagtctaaagtaccatatatgctgttaggacatttctcatccttactcaaatctaaatatagcaagtgaaaatgcaatccctaaaaaagcggcattattcccaaagagcctggcagagcagtgtttgctgccacagggaaggtggtcctgtcctctgctcccagtgttataaaatgtgtcctgctacattaagtgcccatgtccactctgattccagggataaggatacaactaagctaattttcaaaaggggagtgtagttcataggatcgcacttgctaacacagtggagcttcactattggcagaacaacagttttcaaacagatcagctattgagaggaggtgattatactcacagcctcctaattttatcaaaggcctatcagccacagtattctttcaagtatgtgcttcccttgagaatgtaaaattagtatcctggctgggtgggatggcttttccctgaaatcccagcactttgggaggattgcttgaggccagcctgggaaacatagtgagacctcgtgtctacaaaaactagctcggcatggtggcacgcacctatagttccagctacttgggaggctgaggtaggagtaaaaataaaatgagtatcctgtttataaaacttcagagcatgtgagatggctcatgccttacaaaaatgagatccaacaaggtttgagaatcactggattatggtgaatgtgaccaccacctggctatgatcagtcattgccttccagctcagagcttctcaaccctggctgcttgttaaaatcctacctgggggacttgcagaaatcccaatgctcaggccttactccaagccaattaaatgagaacgtctgggagtggggccctggcattgttttgctgttttttggcactggtatttctgaaagcacgcagatgatttaaataggtggcctgggctgaggattgctcctctaacttactggttctcaaacttggctgcacattggaattgcctggaggtgcctgggtccccccaccccaaccatggacatggttgtaattggtgtgggatgtgacctggcctccaagccaggatttgtaaaagctgttcagtggttcaaacgtacagcaaagccttgaaaccactgctgcaagcacatcctcccacagcctctaacagcccatttcaccttgaaaagaaaatccattgtcataagcagatgagcaacccaacctgtcaggaacatatttatcctcctggctgacttgaggcggctgaggatcactgaggtgggagtcaccactgaaaatagtcactgtgctggagagcgctggaggaaatgtaatagtgttagtttacacattaaaccctttgataccaagggccctgccacctgcaccaccagccaagcatccctgattcctggctgcctttgtggcccctgtggccttggatgagtggccacccctcccaggaaacattcagagcacattacagataataaacagatatgactaatgagctcaattattgtaaatttctgggtcatttcttatggcatttccctcccttctcctttcatcttatgttcaaaataatttctttgtatttccctatcaacatgtccaacctgagttggcgcactgccccgagtaggtaaggaggagaggacattctgttttctcaccccttcctctgctgactcccacctccacctcatttcctctctgtggcttgtgccaggtgggccagtacctgcaccatcttgagaaaaagttgctcaaaaagatgcatgtaatatcactctccacggagtcttacaaatctaacactttgagggcataatcttcaaaatttctggtttattgatgagtattcttatatgatttctcaacacattggaatcacctaggaagctttaataactatttttttcttttttctttttttttttttttttttttgttgagacagagtctcgctctattgcccaggctggagtacagtggcatgatctaggctcaccacaacctccacctcccaggctcaagcaattctcctgccacagcctcttgagtagctgggattacaggcacctgccaccatgcctggctaatttttctgtatttttagtagagatcgggtatcaccatgttggccaggatggtctcgaactcctgacctcaggtgatccacctgcctcagcctcccaaagtgctgggattacaggcgtgagtcaccactcctggcctttaataactattgatgccataattgacccacagagattctgatttagtggcgtgacgattagccgggcatggggattttttggatgcttcctatgtgattccagtatttagccaagtcatttgtcaatgagagggactgagaaagaagaagcagaaggacactcatagtgaaacatcgctcaagttgcagtcttcctatggactctcccctatgaactcccaatagcctttgtctcatttagattctttataagcacaagcagtgagatgagtttccttttttttttttttttattatactttaagttttagggtacatgtgcacattgtgcaggttagttacatatgtatacatgtgccatgctggtgcgctgcatccactaactcgtcatctagccttaggtatatctcccaatgccatccctcccccctccccccaccccaccacagtccccagagtgtgatattccccttcatgtgtccatgtgatctcattgttcaattcccacctatgagtgagaatatgcggtgtttgattttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacatgtgcatgtgtcttcatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttacatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttagtttcctaggagatcagaagcggggtgaggccacagaaaaatctcaaaagcaggtgtgtttgttttcagtgtcctttcatctctctaggagttttgtcctagggttgctgtctcattgctcacactaccctcctctcctccatgacccatgaaacgtttttgcaacattgttcgggtggcacagatgcaagagaaaaaactcagtattggtgagagtgtgggctggtgaaggagtgggtgattgacaggatgtcttgtgatgcacaagatactgaaggagcttagggtaagtgctccggcttcacgcactgtggtacacataacgttccctggtcatttcccaatacacattccctggccattctccctcagctttccctccaaggccttttccttcccgtgaacatttttctgttctgtgttccataccttcagcgtcctgctgtgggaccagctctgacagccacaatcaatggccttcccgggagccttctccatttgccttcttccttgctggctgctgtggtttgaatgtttaccccctctgaaattcatgttgaaacttaatccccaaagtaacagtattaagaagtggagcctttggccaggtgtggtggctcatgcctgtaatcccagcactttgggaggccgaggcaggtggatcatgatgtcaggattttgagaccaacatggtgaaaccccatctctagtaaaaatacaaaaattaaccgggcatggcggcacatgcctgtaatctcagctactcaggaggctgaggcaggagaatcgcttgaacccgggaggtggaggttgcggtgagccgagattgcaccactgcactccagcctgggggacagagggagacagtctcaaaaaaaaagtggagcctttaaaaggtgattgagtcatgaaggctctgtccccttggatggattaatccactcatggatgaatgggttaatgggttatcactggagtgggttagtcagcacaagcagggtctgttataaaagctagtttggctcatgctccagccctctctctgtgcgatgccctgcacctcctcagcactctgcagggtccccaccagcaagaagaatttgaccttggatttctcggcctcctgaatggtaagaaagaaatttcttttctttataaattacccggtgttaggtattcagctacagaaacagaaaacaggctaagataccagcagaacctggaactttttcaggtatctgaccctgcagcagatggtgaatcttgattagttcaagcagtggtcttttaccttggctgcatattaataacacctgaaaagttctttaaaaactactgatacttgggcctcaccatcgtttaattggtctttcctgtgcggttctcatgatagtaagtttcacgagatctgatggttttaaaaaggggagtttccctacacaagcgctcttctcttgtctgccgctatgtgagacatgcctttcaccttctgtcatgattgtgagtcctccccagccatgtggaactgtaagtccaagagacttcttccttttgtaaattgcccagtctcagatttgtctttatctgctggtgacactggttctgatttaactggccttgagtagggatgaagagttcccatatgattaaaatgtgcagccaagactgaagatcactggtctaggataatcatggcatttcaactccccttgccagtggttaagatagggcaaacaatgccagtttggcagatgaaacatgagaatgcagggatgggagtggggagatttagaaaaagtgtctcacctttaggaagtgatgatgtttctttccttttcatggtcttggagttgttgggcgggggtgtgatgcttgtcgccattgcagctatcttttgactgtgagtggatataccagaggacatagatttctatgatgaggtttgcatgatgcaatgttaaaaacaacctaggttggccaggcacggtggcttatgcctgtaatctcagcactttgggaggctgaggtgggcagatcacctgaggccaggaattcgaaaccagcctagccaacagggcgaaaccctgtctctattaaaaatacaaaaattagccagccttggtggtgggcacctgtaatcccagctacccaggagcctgaggcaggagaatggctggaacccgggaggcagaggctgcagtgagctgagattgtgtcactgcactccagtctgggtgacagagcaagactctgtctcaaaaaacctaggttttcaacagtgtcatcgagctgctaaacaagtcaaatttggaaccccagccctctagttggggagaggtggcttgatagcatgccctgctaaacatgcacagcaccttctgctgggtgtaaagctctcttagctctaaagctgttcactcatcacaggagagctgccaagagccagtggccttgctgggcaggccttatctgctactgagggctttgggcagtgaacgaagacagaatttgggcagattcaggcttgacttctggtcactgtgtgaattgactcaatgaaatgcatagactaagcgccttggttttatcatctttacaatgggactagcacccaagggttgttgctatggttccatttaaagaactcagcacagtacctggcacgttgtaacttcttagtaagtggcaacttttacactttttggtatatttactctccttatgctgcaatgagcaagaggtgaaataattggaaagaataacaagagagatgtttgatttttggaggactagtactctaacagttttgaaagactgaacaagtttttcctgtggtcccctctgcctgaaatttatcaaaataatttgagcctgattcaccaagtcagcacagatgttgggcccagtgtgactggctgagctctatattctagctctgccagctgatgggtttgatggatgcgtggagcccacaaaacccctgctactggtcgtgcaaaggctgtgtctgagcagcgggaccacacctcccttaaggctgagtaccacttgggacagcagctgtggtggggaggggggctgtggagctctgtggggatggggtcctccggctttgagggctgagttctggagtccagtgtcacctagatccagagtcctgaccatactgggtggggcagtgggggtggggggggtcccatcgttccctagagctggctgtcaacctgactgatacagtttggctctgtgtgcctacccaaatctcatcttgtagctcccataattcccatgtgttgtgggagggacccagtgggagatgattgaatcatggggtcaggtctttcctgtgctattaactttagagtgaataaatttcatgagatctgatggttttaaaaaggagtttacctgcacaagccctcttctcttgtctgctgccatgtgagacagggctttcaccttctgtcatgattgtgaggtctccccagccacgtggaactgtaaatccaagagacctcttatgtaaattgcccagtctcgggtttgtctttaagggcagtgggaaagcggactacgaaaccgaccttgtgcctggaagcagaactgggactggggtatcagatcatggtctccagttggccctgagtggttcactggggctccccgggagcccactcactgcccttggccctccccacccagctgattttcttccccagtgtctacagtccttgtttcctcctttctttcttccacctttatccaggcttcaactgccctgctctctgtcccttctgtcacttcccctgttgggaaatgtccccacaccccccactacccctcgtctctgagaccttctctcagttgggctcaatatctgctccagggaagtctccacgttcacatccccctccagccgcacttcctcacttgcctgttttaatcatccttattttatccttatatgccctctactatatctacttctagtccataattccatatccccctcctgccttttcaggagtcttgctgatcagtcatattgttgatcatccttttgccccaaaacctccagtctcattctcagaacttattctttttcatctatttgttaaaatgtcaggtttctcctatcttaaaaacaagacacatgaaaaggacaccctttgccactaatgtcctctacccaggaaggaagaattgtccagatccgctgcccctccactcctcccagccttcctagccctcggcagtgtggcttcctctgtcattacttctctgaatctgccctccccaggggcacagttgacttccttgtgaccaaatccagaatctccctgaggcagcagcctagaggaatgggtgtggctctgcagcacccccgttggttcaaattctgggccaccctagggagaacattgaccttagctaagtttcttaactctttcaatagccttgaaagggtggggcctattgctttcccagggtccaataataaccatagtgaatatttacggcaggcatcctgggcagggcttctgctcagtgcgctgtagggactgtgagttttgtgtatgggagctcgaacatgtttactgaatgaatgagtacattgtgcccaaatagtattaactaggtactttaaattcccacttccaccttcatccccactctgtccaccaggtccctggtttagtttctgattaagaagcgattaaacaaagactgtcttcttaatgtccaaattaaagctatttctagaatcgacatcttacatggatgatttggatctatcctaagactgagcataagaggtatctttggagtgtctgttcatatgaaggtcacattctgaattggtatgtaaattcaggatggttagattaatatcattctgcagcaaaaatttgatcattctggttatagtcagatcaaacacatttttaaaaactctgtaatccaggtcctcttgtgcaatttgtgagactagaaaatcaggggttaaaaaacccatctcaaggtcctagaatgaagatctttacatgagaaagaaaactactctgtaaaaataagcaggtagatgaaatgggcaattaaaataaaacagttgggcgtcttaattgaagtttcattacccttgtccttggaagtaagtgactgtaaactcaagctgggaactggggagtgggatcttactgagtgatggtaaggggttgcggaggcctactgggtgcaccatctgggggtcaggaagtgtgaacagtgtcaaagcaacaagatcatgggcctggctttcaaagagatttcagtctctttgaggagattaaactaaccccataaaaaacacagcattcgatgcaaggctgaataattaagtgctaaattgtggcacagatgctaagtgctagtggagcccagatgagaagatctatgcatcttggaatagcctgcaaactcttagggagggcaatggcttccagctgagtcttgaggaatgggctcagtttctatgacctcagcctgggcaagctacaaaagcgcgtgaagtgtgatgggcaggtatcaagagaggaaatctgtggtctgggactctcccagtgaaatgactggatacccagctcctccccagccaggagaacttggcccacaaatccctgtggatgctacttaccttgagccctcctggctttcctgggttatgtttctttcctgatctgctttccgtaggggcaggtgaccttctaatatcttccactcaaggccagctcgtgttggccctctgccccttcttccgtctggtgttcttgttatcagaccccaaagtcatatgggctacctattttcagcacctctttctttcagccccctagtaatcatgagtccctctccagagaactctggacaagtcctggaggggctggaagtgcatctgagcagagcatccccacgagcttgatgggctcctcctttgttcccatccccagtcccaactatccagttctagccagacaccacagtctccccacaggttagttgtttctcctgagagcttttattagtcagaactcatagggttagaagagattaaaaaaaaaaaaaaaacctcattctaaactagatcttaaaagagaggaggcatttgttgaatcatgaaaccaaaacttataggggttcacatatggctgaatccaggtgatcccagatatccataggagtccgctatgctccatcaggcaccattctctcgggcactttcccccaagtggtagcaacaagtttacactctgtcagatagccacactgcctaagtcctagggaagaaataatagaatttcttctccatagtcctagggaagaaataatagaattgattgtggtttgtctttcttggaccattttatccaaccctgaatcatttcagccaaggaaatgagatactgttatggccaggactggtcacatgcccatctgtggaggtagagtcaggaagagtgggttccccaagtggaggatgtgggttttattaccagaagaaagaatgctgaccaggcacacatgggtgcccattgtggaagtgaaatggtggcccttgctcccaatggccatgggctgtatgtcccatcattgctgcccctactgccccatgggtaaggctgatgctgaaactcttgtccttacttacccttcagagatgctcagaggcaggtctgaaatttccagatgtttccacaagtttccaacagactatgttgggaaatctggaaaatactgttttcaaagatttggaagacctttagaagcctccattttcccctccttcctctatttttccctctgtggcaatagctgaccaaggaagctttggagatcccccaattcactgcttgtttctcattttgttgaccaacaccttggattcccaaataagaaaagcaatcaggaaggtttcagagtgatgtggaaagaggggcaaggagagggccaggcattttcatgcatagcatttgcacaaggacagagtgccaatctcccagcaaagttggcagacagggcctccagcagttagagtgacaaaaaggtaatcagaaccacttgccactttccattgagacagacatgggagccaaagtgggaacaattcctggatgataaattgtttcttgcttttcctttgaacttcaagatccatccccctgggtccctcccatctgatggattgactgacaagttcaatgggcaaggagaggattccatacccaagaatctgagctgtgttaaggcaagtctctgaagctaattgaatgcgaatgtcagctgccaccgataggggtaataggaagaaaagaattaccttcatcaggggaacttttaggggctgagagaaaaaccaagcagaataagcaaagcctcttgaacttcaatgtgacatttttgcagccccagcaaaagtcagttaaacgctagattttaactcttccttgaagaatgtattgcttttctgcaatcaagaaattaaagctagagcactataaatttttaattgacataactttgtatattcagcttcacatgctgatatttttatcatatcatgaacattgtaaaccaatgccatttttcaaaatcatcataaatgtctgtataattcagggaaaggatataccatgctgtatttaaacatttctcactctttggtcattttggatgtttccaatgtcttgtcattgtaaattgttccacctcacatttctgaggcagtgttgaatgaatgtttattcatttttgccagcattgaatattatttttaaaatctattgccaatttggtaggtaaatagcttctctctaattcacatatctttgactactcataaggataagtattactttgcatgtttattagtcatttgtatttcaacttctaaaaattctctttatgctcttcacacatttttcttcatagttcacaggaactctttatatgttaagtatattacaggccagacatggtggctcatgcctgtaatcccagcactttgggaggctgaggcaggcagatctcttgaccccaggatttcaagagagagcagcctggccaacatgacaaaatcctgtctctactaaaaatacaaaaattagctggacatgatggtgtgtacctgtaatcccagctactcaggtggccaaggcacgagaattgctttaaccaaggaggtggaggttgcagcgagccaagatcttgccactgcactctagtctgggtgacagagtgagactttgtcgctaaatgaataaatgttacaatttattctattagagttactgttaacatcttgttatttgtatttaaaacttttgtaaaagatacaacttagtatttttctaatattattaatgtattttttgaatagtaatacatttgcttggtttaagattaaacaggcactaaggagagcaaagtgtttcctctccagtcttgcccttttgtgactgaggtttcctcctgaaagcacccattattaccaatttttgtgtatatagtcagaactttcttctgcatattctgtatctacaaatttctacatttatttttttcatattccctttttatacaaatataatatttgtaatcttcaactttctttttctaacattttggagttcattttatatcagtacataaaagctttcttactctttttatgatgccatggtattctattgtatggtttattgtagttttatgacatataaaaaagttaaggactttacagtcagatctatctttccatttttaatttaatccattgattttatgcttaaaatatctttcactgtgcagtcacttaaatactcatctgtgttttcttttgtgtttaaactttgtattttaagataaaggtaaattcatctgcaattataagaaataagagatccctcacaccttctacctagtttctctcaatgtcttggaaaactatactaaaatattacagccagaatattgctattgatagttaaattgatcctcctgcctcagcctcctgatgtgtttactttttaaagcaactgtgaaactgttttccagagtggttgtaccatatcgcattcccactagcaatgtatgagggacacagttttctgcagccttgtcagcatctggtgttgtcactattttttgctttagacattctgatacgtgtatactgatactgcactgtggttccaatttgcacttccctaagggctaatgatattgaatgtcctgcatgtgcttacttaccatctacaattcctctttagtgaactgtctcttcacatctgctgttgtctaaatgtttgtcctcctaaaattgatatgatgtaatcctgacccccaaggtgatggcataaggagatggagctttgagtggtggttgggtaatgagggtagaagcctcatgaatggtattagtgccattgtaaaggagaccccagaggactccttctaacatgtgaggaaaccgccagaagacggcactctgtgaaccaggaagtgggccctcactagacaccaaatctcttggcaccttgatcttggacttcctagtctccagaaccttaagaaataaatttctgttgtttataaaccacccaaccgatggcatttttaacagcggtctgaacagacaatgactgtcttttgcccattttctaattgaattatttctttttttactgttgaattttgagagttgtttatatattctaggtgttagtcctttgttggatatgtggtctgaaaatattttctctcagttggttgcttatctttttctcctcttaacagggtctatcacagagcaaaagttttaaattttgacaaagtgcggtttatcagttcttttttggattgtgcttttgatatcaaggctaagcctagccaggtgtgatggctcacacctgtaattacagcacttgaggagtctgaggcaggcagatcacttgagcccaggaattcgagaccagcctggccaacatggcaaaaccccatctctactaaaaatataaaaattagccagccatggtggtgtgcacctgtaatcccagctacttgggaggctgaggcatgagaattgtttgatcccaggaggtggaggctgcagtgagccaagattgcaccactgcacttcagcctgggcaacagagcaagattctgtcaccaaaacaagaaaactaaactaaaactaagcctagccctcagtcctgaacattttttaaattttttttctaaaattttacagaaatttagttttatatgcaagtctgtgatccattttgagttaatttcacataagggtgtgagatttaggccaaggtttttgttgttgttttttggcctccgatgtccagttgcttcaataccatttgttgaaaaggctatcttttctccacttaattgtttggcatgcttatcaaaaatcggttgtgcatatttgtttgaatttgttttccttattttgttttattgatctatatgactatacctctaccaataccacattcttgattattttagctatataagtctcaaaatgaggtagacaaattcctcccatttttttttttcaaaactgtttttggggctgggcaaggtggctcacacctgtaatcccagcactttgggaggctgaggtggggggtatcacttgagctcaggagttcgagaccagcctgggcaacacggtgaaaccccatctctacaaaaaatacaaaaattaaccaggtgtcgtggcacacacctgtaggcccagctactttggagactgaggtgggaggattgcttgagccttggaggtggaggttgcagtgagccaagattgtgccattgcactccagcctgggccctgtctcagaaaaaaaaaaattattcttgatattctagttcctttgcctttcaatataaatattagaataaccttatctatatcaacaacaactcttatgtggattttgaaaggaattgtattaaatctgtatatcaatttgaggagaattgacagctgtactatattgagtcttataatttatgaacatgtaagtctctgtttatttagatatttgatttctttcaacagcgttgtatagtttttagtgtataagacatatatgatttgttggatttatatataaatattttctttgagtgactgactgtaagtggcattgtcttttaatgttggtttccatatgttcattatgatcatgtagaaatgcagtactttttttgtgttgaccttgtatcctgtaaccttattgaactcacttattctagattttttttggtaagattccttgggattttctacataaactatcatgccatctgcaaataggggcagttttacttcttcattttcaatccgtatgccttttatttcccttttttgtctgttgccctggctagacctatcagtactatgttgagtaacagtggtgacaaagacattcttgccttgttccctattttaaagggaaagcattgaggctttcattaagtgtaacgttaactgtagggtttttgtagattatcattatcaagttaaagaaactcccctctatttctatttttctagagtttttttttttttttttataaatgggtgttggattttgtcagttgctttttctgtagcaattgatatgatcacacgatttttcttgagcttgtcgatgtggtagattacattgattttatttatttttctcaaatattgcatcagccttgcatcccttgaaaaacgcttactgctcatgatgcacaattcttctaatatattgttaaatactatttactgatactttgttaaagaactttatatacacaatccacattggtttttagttatattttttgtattgtctttgattttggtgttagcataaaaccaacaacataaaatgaactgggaagtattctcctcttttctggaatagattgtatagaattgctgatagattttttaaaaatatttggtagaattctctagtgaaaccatctggacttgtggattttggtggggggagattttttaaattgcaaatttaatttccttaatagttacagggctattcaaataatctggtttatcttggatgagtagtggtggtttgtgtttctttagaaacactagtattttctttgagtgactgttaagtgtgtttctaaatagacttaaccactattcactccagatgaactagattgtttgattagccctaagctattaaggaaattgaatttgtaatttaaagtacatctattttatctaagttatcaaatatattgtgtagatttgtttatagtctcttttaatatcttcaaggtctgtagtaacactccatgtttcacttgtgatattaataatttgtgtcctcactatttctttgttcatcttgctagaaatgtttcaagttcatcaatcttttcaaagaaacagctatttttaaaatttcaatttcattaatttcctatttctttccttctgcttgctttgggtttattttgccctttcatggtttttttctctcttcttttttaagttcttgagggtggaagcctagattattgatttgagactcttcctcttttctaaacatatgctttcagtactataagtttttccttctcagtactctttagctgtgtcccacaaattttgatctttttttttttcattttcatgcagtacaatcagtgtatttttaacattcctcttaagacttcctctttgattcatggattatttagaagtatgttgcttagtttccaagtgtttgaaaagtttgttattgatttctagtttaatttcattgtggtcagagaaacacactgtataatttagattcttttaaatttgttaagatttgtttttgggcctgtaatagggactgttcttggtatacgttctgtgggaacttgaaaagaaagcgtatttttctgttgctgtgtggagtgttttataaattttgattaaatcctgttggttgatggtgcttttcagttcttttacattcttgctgatgttatgactagttctactaattgctgagaaaggggtgttgaagttccaactataagactatggatgtgtctgtttctactttcagttcacatattttgctaccttctggtcttaggcagaaaattcaaccttattaggagatggtctgctagacctcgttgactaaaaattgagtttttattctatttcttatattttattatatatttttaattttatttcaaagagcaaacaaatgtcttttggagtctgttgacaaattatataattttctcctctgacttatccttaaatgtttcttcaacatgaagtacattgtatttcttaattattcttagatgtttacctcagggttccaagaggaaaatgaggtggctgagctctctgtgaagagacctaagggttatgtgatattgagataatttgttgtaaaatgcctaaagtttcagtcttctgaaacattggcttcattcattttaggtaaaaaatactgacttctgttaaaattcagagcttttgaaaattgtgagctctatgagaggtagtgttggcaaaatgattacaagtatgggctttagaggcaaagttcgggcttcctagttacacttgttacctgtgtaactttaggatggtatgtaaagtctctaatagtttcttcatctttgaaatgggattgaaatctctcaggattgttttaagaatcaaatggataactagtgccttgcattcactatatgtttgcatctcagttggattaagggatggagccaatgagtttgggattggctttatctctagtgtgagggttttcccaggatgggaaccatttcccgttttcctttcgtttgacaaaactgtattctgtaagtcacagggacattagcaggaaagtgccggtggctgagagtagtcagttgactttatcaacacatgtttctgttcttaggtcagaaacatcatctttagaaagtgaaaatatgtttacttgcacacttttatttatatgctaatcacacttactggccatggtacaataagtgtgtaccttacttatggagaggttccaccatatcccaagccaggtattagaaccaaaagcactgtgtggtatccaaatccagctttacaattattccttctgtttagacatgttaaaaattaactacaggctgggcatggtggctcattcctgtaatcccagcactttgggaggccaaggtgggtggatcacaaagtcgagagttcaagagcagcctggtcaacttggtgaaaccctaactctgctaaaattataaaaatttgccgggtgtggtggtgcatgcctgtaatcccagctattcaggaggctgaggcaggagaatcgcttgaacccaggaggcagatgttgcagtgagcagagatcatgccattacactccattctggcaacagagtgggactctgtctcaaaaaaaaaaaacaaaaaaaaaaacaccaaaaaaaaacaacaaaaaaactgcaacactgacttctcttttgtggtagtataaagattaaaaaaaaaaaagcattactgtgtctttagtaaagaaggggcacaaaaggtatcactgattgggaaaaacctgtgaggcaaagcagtttttatgaactcactgaatatcttagttgtccagtgactttctttctgcgggctttattttgttaaatcattttgatttaaccaggaaaccagagcaagaaaggctagttagcaagaaacgattcagtcctctattaggtatttgtttccatttgacacatagtcaggagtcttcacagggctatgggggaacgatagtgactttttttttttttttggaagagaatgatcttggttaaatttagcaaaactcttagtaggtctggggttccagaaaccatgtgatggctctgcaaggccttgcagatgcttttaaatattatttgggaacaaaaatgttccctttggctggtgcccttgttatgttttctcatgtcccttccctacatttctctattgctctccatgtcaaagaccaagaatctagaatccaacatgtggggcaggcactgaacccccatcccctagcatttgactcccaatattcctggggaaatgaggtttgggtcaatgcggagtgaggcccttagtttcacaggcaagatagactgactcttagacaaattggagggagccggtagaaatataaagaaaccaatttgatcttcagggccaccctctgcaggggaagaattatcaccttcaagaagcttttattcagtggctaatgaagtatggtgctcttggggcccatctttcagggcgagtgattcattttataactagttatctaaataagaatgcgtgtggcatgaactccagttttactgaatctttctatgactgtggtgttgtttactgcagatgtttcaaaaaaaaaagaattcaaactagttcaggcagatggcccggtggttgggagacaaagtgctgattggcagtcccagctgctgctgtcggagtcacctggcagacctctgagggggtgattaagtgacaggtgtgctggggatgtggccagccgtctgtcctcaggtccttttagacaccatctgcaggtggccacgtctgggctgtgagtcaaagctacaggtgatccgtgagaaggaggaagtgggtttggcgctgtgcgatcacctccatatgcttgcggggaagacacatgcagggaagaggctgggctatagattacaaacaaaaccatcttcttgcatgagaaacagagactgcagtgttaaagatcctccgtgagctgctgtttcaattcatgattacatgggggaaggacttggataatgtaattcttaagtgatttgcaatgtgcctttcaggcaggttttatttacaattctacatgaagcctgctctcagtggctgggagaaggccagatgagtgtttgctggctccattctccagcttagactagagctggggatgaacaatgcagatcaagtggcaggacttggccagcccactctccagccttacagagccacagagcccaggggattcttagcggagtaaggtcaaggtgcctgtctcagtggagtaaggtcaaggtgcctgagcagcctgaggcctagaagtcacctggctgggatgcccagcagggagagcactgtgacctgcagacagtgcctgcctgcctctgcccagccaagccaggtccccaaaccagcctcaccctccttccaaccccttttttacctcactacctacagcagtacttttcaatctgcaggttgcaacccatttgtgacttgtgaccttcacttagtgattcacaacaagcattggaaaaaaatagaattgaatagagagaattagatttctttctttcttttttttttttttttttttttggagatagggttttgctctgttgcctaggttgcagtgacactatcacagctcattgcagccttaaactctaaggctcatgatcccaagtggctggaactacaagtacctgccaccatacccagctaattatttaaattactttttttgttgtttgtttagaggtaggatcttgctatgttgcccaggctggtctcacactcctgacctcaagtgatcctccttcctcagccttccaaagtgctgggattacaggcttgagccacctcacaagtagtacctactgtttcatgaaatgtattccaagtgtgccgtgtgtttgtttgctgggtgatactgtaaaatatatcccttactgtgggtcaaaacgtttaaagctgctagacatttctgttagcaaacactccttcctaagtgagatccccccaacaaatacacatatccctcaaaaaaaaaaaaaagtgccaaagctgggcacatttaatctaacttaaaatagactcttgtaagaactctggccaacctgccaattgaggttaatgtctttagggtgccctctgaattcagaagtgctgagtgcttcttacggagaatgatgggagaagggggagtctcagggacatttcagttattggtttgtaaaaaagcatcccaaaacttagtggctaattaagaatgggttccttttatgatgcttgtgaactatatgggttgagattgaagaggggcatggcagggatgacctgactgctctgtgacgtctgaggcctcaggaagatttggtggctggaggcgacttggcctctgagggctagaatcactgggaggcgctcacaggtctagcagttaatgttccttgtcagggacacttcagctgaggctgcagccacagcacagcaatgtcctctccatgagcctgggattcttcacactgtgacctccaggtacacagcccaggattccaagagaatcaggtgagaactatgtggtccctttgggaccttgcctcacaggtagcttctgctgctttctaacgacttcagaggagcccttgagagaaaagacatagaccacacctttctagggagggaaagtcaaagaatttcataagttgctgcaggtaggaagttttttgaggggtggggtagggatttgaattttagtggcctttggaggacaggttgcagttgaacgtggtgggacagtacccatgcggcagagaccagtgggcacgtgacctggcctgtggtgcagaagaaaagggatgtggatccaggcctttatggaggctctgggggcagagtgctgcaatgagtcctgagaacaatgtatgcgtgaagtcttagaggagcagcatccccgaaaggcctgcgtgttcctctctcaggcaaacagatggtcagaaagcaatagctaattattagacagatgagtgaacacccatgcttgaagattacctgagtgctagccaccgaatattcagaacaaagaggaagcttctgaagccagaaatggtacagtcactcccataactcccttactagaaaagcctggagaggtacccagagggcagggaggttgaaagggaaggaaggctagcaagatctctgcccctttctgtacccaccctgagtccccaaggttctgtctgaaagggagggctggccaagtctccagttctttcaggggaaaaaaaaaaaacgtagttacatttccaaagggaagatgaaaggaaggaaagagaactcacttctagaggcttctaagaaaaaaacaccgtttcgaaaagcaggcaggatcggatgcaaatgaggctttcagaggcaatttggtagaaaatgggatgtctattagacgattaccagtgttcgctcccccaaactggaataagcctcttgatttgtctgcattcatttggataacctacaaaatcttgtttatggacttttaacagtgagagagagcatttctggagacactgatttccacagatctcagaacctcctcaaaaacctgagcacgggggaaggggaggccatgggctctcctgccccccaccatcagggctgtgtggtgggccagaaggccattcatggaggtctcaaaatacaccaaatgtttttgcactgctttggttgacattctttacgtgggagcccctggtatattaaatagtaagccccacactccctcaacctcacagaggtgtctcatggattaaggatttaggacaacaatccctactgcacccgcccctttaccgttccactgcttttcccgtaacaacttgggggctctctgtgggcccttgaagcagtcacattgctgccgtccccagctagggtcataggagtccctgtcccccaggcctttccctaaacccctattctagcttctggactctcctcaggtccttggagaagagtcacctcctgcccacaaggtgtccctctgccagtcccagtccttgagcccttccacatgcatcagagtttagggattcatttctttcccatccccttccgtcccctccccgcttctcccgtgactgatgtgagttgccctcgcacacattttccaaactctccaaaaagcagctttctctgcgcgcatctgtgtgtgcggacggggcctggacttcgaaccgccggcgcggctccacgggctccctgctccggccgcccccgggatgcgtgttgtaggcactggcgtggggaggtcagctggtgctcgaggtggccagtggagtggacgggcaaggggggcgcagtttgcgaactgctggggttctcggagggccggacagcccggtgttttctaataactccctcctgccgcttcagatttggaaacgcatttcggggcgtgatcacgcagctgcctcttggcattctggtgtccctcgaggtgaaggcccctgggttgggcttatgttgttgttatcgtggggtacccgagggggccaaagagagaaatcaacacccagtgatcgggcttctcgaagcatccccggttttttttttttttttttttttttaatgccccactcagagtgaccagtggcaccgcagaaagttcattaacactcccatttgtggcgtctgattcacggctgctgccgctggtgggaagctgggagctgctgctgcgagagcaaatcagcttgggctaatgcatatgttaataacgctaatgttggagcatttggtgttcctcaaagaaagacggtaaagtatctgcgctgtctcctccaacgcttaataaggcgggtggcggggagaggggagcaacaaaaagccattcacttggagcatttatagttagcatttatagaggagagcagcctgtcggtgattctgaaggcaccatgccaccactcagccctgcgccttgcattgttcagcaactccattgtaaaacggtctggtgacaggcgcgctccagcttctgagtttggaaaggcaaggcgtgctggctgaccaaacggttcccttgctagcctctcttccttaggaggaatttgctgtaccatctgttgtctgcgtgtttgctggtgtccctgaggatgtacccaaatgagacacccttggggccttccctggcaatccttcctgacatcaatttagcaacatcaactcccactttcctggatagagatgggttaggatgtatccacagcagagctgctgaattcaggcctggcaggcatcacattttatttttaaaccacaaggtgatagtctttaagcttataattagagatattctagaggaattcactcagacacttactgcgtggtgcacagtttgctgggtcttcaaaagaatatggtgctgtctgagattgtagatatgtgcccaccatatgggattctcgatgtctttcttcatgtacctggtttcaaatgactctcagcaatatctccaacttcttcaggaaatggagatagtttagttctttaggttttctttcaggttgatgtccatcagaaaatatctctgatgtaataagtgggctgcaatggaaagtaggattttaaaatttgggtatctctcatactgtatcaagagtttatatgttcaatctggttttctgcttgtcagcattaaaagactgaaaatatgtttccacagttaaaatttgtaaaggtcttgcggtaaagactgcattgaaaagctttggttccagagagattaggacggtccgggatgattctgatctgtggtgattgctgtggcatttcaccagcattgtatctgctggaagtgggagctgtcaagtctttcagtgaagttgtgcagtttaaaaaaagtatctccaaacaaacaaaagcatagaaaccaaggttctacagcacattaggagatctgtggctctttcgccatttctccagttattttttagattactctctgtcataataggccaagaaccaggatactgttaaagaacaactgcctcttggagctggggccagtgttagtgttaaggtccttcataagaagtgtatatttgttgttacttggctttggactatagtgaaatactttttaaaatgggagtgtctttgctttcttgattaggtcttttcttttttctttttcttttcttttgagatggagtcttgctctatcggccaggctggaatgcggtagtgcgatctcagctcactgcaacctctgcctcctgggtttttaagcagctctctctgcctcagcctcccgagtagctgggattacaggcacccaccaccacaccctgctaatttttgtatttttagtagagatggggtttcgccatgttggccaggctggtcttgaactactgacctcaggtgatccacccgcctcagcctcccaaagtgctgtgattacaggcatgagccactgcgcccagcctagatttgtctttaatatatgttaaagtaagttatttttccatggccatgtactttctggtgatggaacagagagggcagtctattatgaacatgaggagttgactggaataatgaatgaaaaccagctttaaggttcatgagtttcatggtaagggtgctgaggtgtcttacttgggccttcagtatgggtataactcatggagtataggatcttgacatcctattgcagactagaaggttcagcctggaaagagactgaaggtgagaggaggtggaaaagaagggaaaaggtgtttgcgattgtgatggagaaggtcctggagttaaaaaaggcaggcagtggctagcaatgtatgggttaaagacctgtagcactggtccagctctcctctgtacccctttagtgagagggaggttctcttcgcacttgcaccttctcccttctcagcagaagtaagagctctgtatcccttggtgggagggaaggatggccaagggtcttagttattgcaagataaactatcccaacacttactggtttaaaccactaccaatttattatgctcatcatttctgtgggttaaggcagggcacagtgagaatgtcttgtttctgctttgtgatgtctagaatctcagctaagaaaacatggaggctgggggctgacttgatggctgggagcctagaattatctggaggctgcttcactctgtgtgtggggcctgggctgctgggatttctgggagaggagaccgaagactgcttgtcattttccttccttgaagcatggtggcattgggaagtcagaattgaaagtctgcttacctggaagctcagggcttcaagcttgaatgttccagtgaacaaggaagaagctgcatcttttcagacctggtgccagaggtcacacactgtcaccactatcacatgctattcatagaaccagtcccaagtccactgtgatgagcagaggaggactggactccaccccttcaatgcaagtgtgtcaaacacacattgtagaagaggctgtgggatgagagatgtttttgcagaaacctttggaatcagcctcaaatggggagatagagaaaccaagcagaaagggtctgagggcaaactgggcctgctcttgctctgatctccccttagaacagctctaacttagactctgcaaatgcctaaacaactggttggtcaagttgatcatatttttaaaaacccatcagattaactatttggggttgtgtaagccaaagacaaatgggctgactgagagctttttcactgttccaagattgttatgtaggtccaggcaaagaatcgtgggacccatgtctgcaacaaaagcttggaggcagcctttctggccatgtccccccctccccattgcccctctgccttcttggttactaagcagttacctggcaaccatgcctcctccacatcggctgccgagccaagaggcttagcctgtcctccctcagctctcaagtctcccatggatcactggggacaggatacataatgagattttaattgtcacgttgaatcaaatcattttttccatgtgcataacttctaggcagagatgtaatttcaattaacttcgcttatctgataaaactttcatatcctttaagctaatttcatttgaactaataggcactatgctcctctttgagttccagctcagatgtcttaggcagagccgagatctcctgcatactcgggcacattagagagcgtctgggctgtgtgtgcagaagtggcctctatgcttggacacagctagtttatggagcctttccttttgcttttctcacttgatgaacattcctgaaagcctatttggttttattagttttcagcttaagggatcagtatttcccaaacaaaaggtgtcccattgctctaactgccagagccataaagattaaaattacacttaacttgaaggaatgtctgtatttctccctgctgctacaggacctggggcagctggttctatctcagtgatgagtttgagcatttgttttattaagggaagggggaaggtgagaaaggcattgtaatttaatatgtgggagaaaagggctgatgtgccttaattttatttctcagtaacccccatgaatgtgctagttctgcttaaagttcatttgaacaaaaacatgcctttgcagaaattaagctgctctcattatttcttttcatatagtagaattaaacttcaaacagtttatcatttgttctttgacataatactgagtttggccaaaaccaaataacttgatgctattgagcaacagaaattcaaatgcaaagatgctgcaaggtaatgtttaaacaaaccacacactggtcaatttttggatttcactgctagcattttctggctagcaagtttgtttcttatcaaatcaagaagagaaatctaaggaatgagaatgagagagaaaggtttagtcagaaggagaaaacacagtgaggttgaagatacacacacacatgcttacatgtgcacattcacacagatgatggctaggtcctcagaggatcagccctgagcttctagcccagagtgtcactggtttcctgtgtgaccttagacaagcactcagcccctgtttctacatgagtggaatgaggagtggactaggcgcaagacctatggtgggctgaggcttactagtatttgattcaaagccaagcagatggggttgcattgagaccacaagggtaggcactgagtttgggacttgccaaagaagagaagattaagagactgtaaaaagagtcacttgctttaacagtggcactcaagcctaagcactgttcctcatccttactgtcagcatgatgagtttgggtctgtctttcagggatggactcccaccaaccacctgggaagactgatatattgtggtggttaatattgagtgtcaacttgactggattgaaggatgcaaagtattgttcgtgtgtgtgtgtgtgtgtgtgtgtgtgtgtgtgtcttgttaaaggagattaacatttgaattggtggactgggagagacagacccaccctcaacctgggtgggcaccatctaatcagctgccagcacagctaggataaaaacagaggaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaacaaaaaaaaacagaggaacattgtaggactagaccagcggagtcttctggcctccatctttctcccatgctggatgcttcctgcccttgaacactggactccaagttcttcagtttttggtctcctggacttacaccagtggtttgccagggactcttgggccacggactgaaagctgcactgtcagcttccctacttttgaggtttggggacttggactggcttccttgctcctcagcttgcagagggcctattgtgggacttcaccttgtgatcgtgtgagtcagtactccttaataaactccctttcatgtatacatctatcctattagctttgtccctctagagaacactgagtaatacagatttaaaaactcaagtgccaatgtgacaatttatggtggaattgtaaaacgagaaacacatctattatgcagatcccagtgtttgtagccaaagatcaacatcacaatggataagctgcaggaaaggacatgttggtagtttccagtttggggaaattatgaaataaaactgatttaaaaaaaaccatgtacaagctttcgtgtgaacatggctttgaattcacttgggttaatggctagaagtgggattgctgtgttgtatggtacatatatggccagtgtgtgtttggtgtatggtcaaattgtcttccgagtagctatgccatttttcattcccatcaacaatgaataagaaccaaattataattatatttccttggtaaacagggtctttttcatttgtgcaataaatagttattgagaattcattaaatgccaagtggtattctagacattaagagcaaaatagacaaaaatccctgtcatcatggagtttattgtcagttggtggaggaaggataagaaaataaacaagtgccacgtatgtagcatcccaaatggcaatcagtactaaagagaaagatcaaacatgggagtgaaactgtagagagtgtgtcggcaagggtgcactgagacagtgacatttgagcaaagacctgaaggaggtgaggaagtaagccctgagggtacctaggggaagagaattccaggtagaaggcacagaaggtccaaaagtcctaggataggtgcatacctggtatgtcaagtaaggctggtgtggttgagcagagtcagggagaatggggtagtaggaaatgaggtcagggaaaaaagtggtggctgagggtgaccaggtcttggagaaccacagtaaagacttcatctttttcttggagctggatgcagagccattgggagggcttgagctgaggagtgacatgatctgatctgactgagcctttgaaaggatcactctggatgctgtgttgggtagcagagactaaagggtcagagagaaagaaaggagggtaattagaaagctaacgcagtaatccaagggagagacctgtggcttagaccaggaggtggcaggaagtgattggatgctaaaactaatgttagactggagccagcagaatttcttggattgattggatgcagaatgtgagagatatagaagtcaccaggtacctggggttgggccagaccctacagatgaaggagttagtcctctataagactatcctcacttgagacagcagctataaattcaagagtcccagggccaccttcacttctaaccagctggctacacatttaggtttgatgaccacgaccaccctcaggtttcgtaattcaccagcaagacccacagaattcactgaaagcgctatacttaagattacagttttattacagcaaaaggatacaaattagaagaattgcatggggtaaaatctgagagtttcaagtgcaaagcttccatccttagggacacattgctctctcaacacaatatatgacaacactccaagggtcgtggcaactggggaagctcacctaagcttcagtggccagtgttcactggcatttcactacataagcctgattgattgaatcatagcccaggtcttcagctcccctcctctccctcctagaggtcaggcagatatcatgtgtgccgaagtcccaaccccctaatcacatggttggtttttctggtgtgacttgccctatcttgagctatctcattagcaacaactatgtagggacccaccatgagtcacttcattggcatacattatcagacatggtctgagaggctcagcatgaaaacaaagacattgctctctcttcagaaattcaagggcttataggttaactcctaggagctgaggagaagagccagccaagttctttactacacataggataacttagaagattttgacctgaacaaatggaaagatggggttgtcatgaactgtgctgaggaaggaaacagcaggcttggggagcctgggagtgtatttggatatgctcagtttgatgtgattttttttttctgtcacctaagcagagatgcaagtagacagttggtgttcagggacaggtcctggttggaggatgaaaacttcaagaaagagatgggattcacattagagagatatttgaggctgcaagtcctgagaccttgtggcactggaggaaagaagcgctctccatctggctctttgggcagctcatctctgtcctccagtttaatcattccttgctggtcacccatcgttgcctagaaactcattcctcccatcccgcctccctgatattttgtccaggtcactttgactggaggtccaagtgttgccaaattctttagtcaaatctttacaggtaatctctgggttgattgtcacagaagtggaaaattacagccaggatgggtgactttacaatgtgaacaatcagacagtgaccttctgccttgcactaccttatcactgggggacccgtcatacccaccccattctgccttcaaactcctcataaccaggggtggggagcaggggtcaagtgaccctgggaaggcatttgagtcttctggggctgttagacaccattcattaaaaggaaacattggacttgacgctttcctgggtcttttttggctaaaatgatctctcagtctaaagagtcttgtatgctggttgtatatgtgtatgtgaatgtgcctgtgcatgtcttgcctcctcaatagatagtaaaatttttatgcagggatgttaaaggatcctagagcagtttagaactgattttgcttggtcccatctagtatttctttcctatccctctgggcgtagaaattgacacatagtaaatgttcactaaatttttaatagtagtgaattgaaacagttattcagaaaatttaaatcccttccctgcctcccacccaaaccaaactaaacacttttatctgtgagttcagagtgttttagatcctgagtaatctgtttaatagcatcagttttcacctttactctggagagatggggagagagacaccgagatacctcttaaagacagaatagaaaggtggcttctggggtcagtgtctggttgggttttattccaaatccaccatttactaactctcttgggagagttacttcgccactctatgctttggtttcttcatctgtaaaatgaatctaataatggtacttatctcatagggttgatctgaggattaaacagtttaatattggtgaagcacttgaaatactgtgtggctataatgaaggctatgtaagtggaggtggtcttgggtatttagaggtgaattgatttgttgttgttgtttcctttttttgagacagagtttcactcttattgctcaggctggagtgcaatggtgcaattttggcttactgcagcctccgccgcacaggcttaagcaattctcctgcctcagcctcctgagtagctggacttaccggcgtacgctaccatgcctggctaatttttatatttttagtagagatgggggtttcaccatgttggccaggctggtcttgaactcctgacctcatgatctgcccacctgcctcggcctcccaaaccactgggattataggtgtgagccaccgtgcctggcctttttttcagaataacattaggactggccaggtgggcggtaatacttgtagcacatacctcatgcagttagtttgcactccaagctaaggttaccatgggcctaattttgtttttttcaagtgggaaatgagttcgctgtcttcgaagttgtaacctacaagtccttgtcctgtgtggcctggtgacctagttggaggtgtgtagaagacctgggggaacagatcagcacccccacatccccaccactggagacgactcagagttcattttctgctgatcatgggttcaattccttttctttaggcatggaaggtgacttattttattatggaataattctgtgttgggggagagtggggaacttgttcagtatccagaagcatttacccttcattctggctcagtcatcataatgtgccattttttgttgtgatcaaagtgtgtttctgttcctgccaagcccctgtgtcatgagaaccagcgcagcagctccaattttactgctgaggaataaaccaccaaagcaggtttctaatgaaagtgctagggagactttaattataaccgtgctcttgagctcccttggcaacaccttctcttttgattcttttcagagtagaaacaaaaatggagctgctggtaagagctcatgtcagggagccttagtgagctgggactctttagtgtagccagctctcccccacccttatggaaaagcagttcctcccagatcacctgagccccactggctctccaagctggcctgcaccccagcacagtgcagggaagaacatcttcagggtgctagtggccgattgcatgcggaaggaaagagaccaagcttaaagaaaatcctgggtttattgcccccactgagatttttttaaaattgactacaaagtgctgttgtctgggctctttggaacaggttgcatgtgtttgttcaattgcattagtttttgctctgaaaattcccttccttttctctcctctcagtggcccatgtctaggggctttgttttccttactccccttttccttttctctctctttgttttgcaatgcctccagcacatagtaagtgctcaataaatggtgttcttcctcttctttcacctggatctattctgagtttacttgctttctctttgtttttgtgcccttatctttctccctgccttcgtcccttcccccagccacctgcatgctcttcatcagtctgattcctttccccagtcccattctccttcctgccttgtgtctctttttttcattcaccttcctttgatttaaatcccaatctgaaattcttctttcctcccctccttctcccaatctttatttttcaactctttgtctctcatgtggcctctacctctatttttccactgtccctttgcccaaatgcttcttagccttggcttggaacattatatcacccgagaagttttaaaaacatcccaatgaccaaactgaaccctagacaaattaaatcaggatctctgggaatggaacttcggtagaaatgtttctaaaaagatcccctgttgatttccatgtatatcccaggttgagaaccattgcctggctttttgattgaacatgtttgttgtgcaaagccaactttatattgctgtggctatctctaggtggcttaactgatgtttccgtttttcatttagtggaaagcattttccttgtgtcagttcccagtgtgggtcctgtgacctttgttcttcctcaaggccataaagagtccaggtcaaaaatgaaggagaggtgaggacaggagtagcatggggaactgggatgggatctaagctaccctaaatgcagagagacagtaaaggcacagccaaggactggagcttccagtttctagacacccaagtggaaagctggcttgggttggggtcaggctatgtggaaagggtaagtgcccctgatccaggcagctctgcttacattggcttccagaacatcagcttcccagcctgggcagcaagaacagtgctagcttctaaacttctgcaaaccctttcttctgagcttctccctggctctggatttcaccacctcattctctgtcaggcatgttgggatgatgcactggggactctggagcaggctgttccttgacagtctcttcactgaacacagagtaaggaatttacttcatgtaggggacacctcagaagcaaatcaaacacctgctcagtggactctaaaatttctagcacttgtcaagtagagaaggaagcagcagatccagaagcactcttggaagccctgcctcacattctgcagtttttaccaggcttaacctggaatgagccctgctaaacactgtaaagccataggcatttggcatgtagtctcaccattgtataatatatgtgttcatggaccatttataaatcagctgaagaatatctgataggggaacccaagtcaaacaggcaatatgaaaatgatgatgaaaatttaccaggttctaggggtagggaagtccaaacactattgacccactaggcagaaattcaaagtccaggagagagaatctgcttgccccatagtgggtcacacagggtctcctgatcccatacccaaagtctagtacccatgcatagtgatcatctctggctccttgactttgtcattctgtgctgagaagtgctgaaccagcacagccacattgagctcagctaatccatcagtagctgtttgttcctgagactgaccagctgcaagtcggggccacagaaaatgcagggctggcttctcaaagcaagggcagcctgatttgctgcaccctggcctccagctcaaaggcaggaggataagttggtggcagctccttctgaggctgagaattggctctccttgcaggaattggatcttatatttagttagtatctaggcactggctgctacatacagattggtttaaagcctcttacttaagaactttatttccgggtatttgttaaaccagtttcaactgagagtaacctagggaagcctatggctctcaatttgagttggataagaatcaccaagggatttttttttttttaagataatgatgcccatgtccaaagcttctgatttggctggtctaaggtgaactttttttttttttttttttttaagcaatggggttttttgttgttgttgttgtttaaggctcccaattctaatgctactcagggataagaacaccagtagagtgaaaagcccatggagaggccaggacaactgaattccttgttctagagtttaggtttgccacttcctagatgtggcactggggaaaggctatgctgctcctttaaaatgtgaagggcaggctagatggaaaagttccacaagcatcccagtccaccagggagcctagaaattctacagaagctctgaattccacactaggcagactaaaatccacaccagcatcctagaggcactgggcagtcaatctcggagatccctctgagctagaaagtctagggccctgtgaccttatgtgagcagcaccatgacatgtaacaaggtccctgtcctcaaagcatcgagaatgtaattggcacaggtcaggcacatggagagcatccaggcacgagaaagaaagggatgagctgctggaaaatgatgtagcagggaaataaaacagcagcaacaacaacaaaaaccatcaaggttagttgacaaggaggcaggaagggggtggaggtgcggtggtggtgatctccaaactgttttcatgcctgtgtgaaatggtttatgtgttctctactttaaccaggagctctcaagggtctaagttataaagggggtggaggaagcggctcctgctgggcagataatccaggcacgagaggattatatttttaacaactttccagcgggaggttatggattttcttctctttgggactcttaaatatctttttaaaaagcaaagaaacatctatttgtctttcatatttcaaagatgcttctgctttcctataatcagaagagcatggtgatacctttgtttcgatgtgttttccagaagaggggtggggctggctttttgccctatcctgttctctctccgtctgcctttgcaacagtttttgaggcaactgaccgtggctagaggtggggtctgtagctgggagagaatttttctctgcacgaggtg

SEQ ID NO: 84 - DNA, 135093 bp, Homo sapiens
acctgaaggcaattgctttgagatctgttcacaagagccatagatttatcatgtaacttaacttcatttggtacaaactttgttttttttttggagttggccccatttgggaaaatcagaatgtagatctggaatttaaatattgcctacaaagctaaacagacaaaatgcagttgttgcttacctgaaacaaatgtttgcggcatctaaggactgataggctgggacagaattaagatagtgttaggaaagggtcccctaaggttgggtcgagttgccctttcataggaagaagagaggcctgggaaaactttctaaccaggaaggtagacattaatgtccatagttaacattagtcaatgattatttactaggtatgctctttttagagacgtttatgtacactctcgtttagtcttagtacagctcataatgagctggtactattataaccctcattttacagaggaggaaacagccttcacatgtgtacagaaatcagtgaagcctgcctatcacccatacttgctgggttcaacatgaacggcacaggcaaggagaaagccctgtgaccagcggtaccagaaagagtgaaagggcgccatctagtgactgtcatggtggttggcagtagaggttggaagccggtggttttttttcgtgggttttttttgctgttgttttggggttgtttttctgtgtgagacagagttttgctcttgttgcccaggctggagcgcaactgcggactaccaatttcagttgtttctatctactgggaaacggccgctccctggtgccagctgcaaccaattatcattttagcgaggcaggatgacaacctccggcccatcacgtgatggtcgcctgacatttctggtgtgtggggggagctgtctcctgccctgctcatgccccactagctacctactgtaacattctcgggtatctggaatacagtactaagcatcttaaaaaaaacttcactggcggccgggcacagtggctcatgcctgtaatcccaacactttgggagaccaaggcagacggatcacgaggtgaggagttagagaccagcctggccaacatggtgaaaaccccatctctactaaaagtaccaaaatgagccggccatggtggcgtgcgcctgtagtcccagctactcaggaggctgaggcaggagaatcacttgaacctgggaggcagaggttgcagtgagccgagattgcaccattgcactccagcctgggcaactaacagtgaaactctgactcaaaaaaaaacaaaaaacaaaaaacaaccccccccccccccccacacacacacacacacacacacgcagaggcaaaatggcggggggtaaccttctagggggtcattccaccggaaacgggaagaacgactcaggtgagcatgcctgcagctccagtaaacacacgtaactccggtaaacatgcttgcctcccaagcacaatcaggtcactgcgcatgcgggtggctcaccctaagggaagaatgaagggaaaggggtgcaagacgccggaagcagggcagcatgtaaaatcctaggtccaaggtcaaacggagcacttgacctccaaggtgcccccttaagcctcttccaagtgtactttcctttctttcattcctgctctaaatctttttcatcaatttccactccgctgtaaaacttgcctcggtctcttttcctgccttatgacaatctatttttttcttctgaggaaggaagagttgaggctgctgcagacctgtacagattcgctgccggtctctcagataacttccactactagcaagaaagcaaacacaccacatcaatgaaccaccaccatgtagcttaagagctgtaaactttcacttttacttttttttttttttttttttgagatggagtctccctctgtcacccaggctggagtgcaattgtgcaatcttggctcactgcaacctccacctccggggttcaagcagttctcctgcctcaccctcctgagtagctgggatgacaggcatgtgccaccacacctggccaactttttgtagagatggggctttgccatgttggccaggctgatctcaaacgcccagcctcaagtgatccacccacctcagcctcccaaagtgctgggattacaggcatgagccaccgtgcctggccaattcttcactttttcaagtaaatatatgcacactgattaaaaacccaaatgaacgaaagctagatacagtgggaagtcagcctccacatcccccagctacccagtcctccccagaagcaactgctgttaccagcttcccatgtccccttccagagacagtctaagtaagcaaatactttgatacaaataatagcataccacggtagccggaataaagcctcctcaccaaggtgtccgtgtcctaatgcctgggatcagtaaatatgtgatacggcaatagggacggggcagctgattcaagttaaaggccttgagaaggcagattatccaggtgggccctatgtaatcaaacaaatccttaaagctgagaaccttcccaggctgtagtcagaagaagatgtgactttggggttagagagacgcaaagttgctggtactgaagatggaggaagccacgtaatgcaggtgacaaaaacactgattctctccttagccccctggaaaggcgtgcagccctgctggcgccttgatcccaggcaggtgaggcctgtgtcagacttcctaccccaaaatcagaaggtaataagtttgtgtcttaagcccctaaatttgagaacatttgctacagcaacaatagaaaactaataaatacactagtacccttttctttccttctttcttcctttcctttttttttttttttttgacggagactcactctgtcacccaggctggagtgcagtgacgtgatctcggctcactgcaatctctgcctcccctgttcaacctgttcaagcaattctcctgcctcagactcccaagtagctaggattacagatgcacagcaccacacctggattttttttttttttttttttttttttgtatttttagtagagacatggtttcaccacattggccaggctggtccggaactcctgacctcaagtgatccacccacctcagcctccactgcacccagcatcatcttcttcttctttttttttttttttcaagataaggtcttgctttgttgcccagactgagtgcagtggtgcaataatggcttacagcagccttaaactctgtggctcaagcgaccctcctgcctcagccccgggagtagctgggaccacagatatgcaccaccaccctcagctaatttttaaaaattttttgtagagatggggtctatgttgccaaggctggtcttaaacttctggccttaagcaatcctcccacctcaggctcccaaagttctaggattagaggcatgggccaccgtgtcccacctcctttcctcacttaatacattttgaagcctcttcccttttacaatatttagagctgcctcattctttttaatggctgcatagcatctcatcatatgagtatttaatcgttctattaaggatggtcacggggctatttgagacatataaataagttacaaataagtctgtaatgtcatacttcccaattattctcatctcatagcacacacaaatatattaatatttatataacacactgaagtgaattgaaggtactgaggtcatttaccttggaccttgatggaaaatgttactaataatactttctttttctttcttttttttttttaaatgagacaagttctcattctattgcccaggctggaatgcagtggcatgatcacggctcactgcagcttcagcctcccaagtacctgggaccattggtgcacaccaccacacctggctaattttttatttttagtagagacgaggtcttacatgttacccaggctggtctggaactcctaggctcaagcgatcttctcacctcagccttccaaagtgctgggattacaagcgtgagccaccatgactggcctatattctttatattatatagttttgttagttttttcagacaggctttctctctgtcaccaaggctggagtgcagtgaaatgatctcagctcactgcagcctccacctcctgggctcaagctatcctcctgcctcagcctcccaagtagctgggaccataggcaagcactaccacacttggctaatttttgtattcttttggtagagtcagggtttcaccatgttacccaggctggtctcaaactcctagactgaagcaatccacctgcctcggcctcccaaagtgctaggattacaagtgtaagccaccacacccgacatacagttattaaacacacaaacacacatacaggagaagatattgacattgaatttatataaaacttttttttaactgagggtcccactctgtcacccaggctggagtacagtggcgtgatcctagctcattgcaccctcaaactctagggctcaagggatcctcccacctcagcctctcaagtagctaggactacaggtgtgcaccaccacgcccatgtaattttattttatttttttagagttagagtctcttattactgcccagactggtctcaaactcctgggttcaagcaatcctcctacttcaacttcccaaagtgttgggattacaagcatgagctaccatacctggcctatacaaaacttctaagtctttaatttttttgaagaagttgattttttttatttataatatcaggctttatattatttaatattttaaatatcaggctttatgcctgaaatagctgattctcattattcaccacagttatgttctataaagtcattgcaaacactgaatctgttaatactaaattattgttcctagtggaaatacagggttaagttcctatgagcctctggccacatttttataaactgaaatgccacttgtggtacaggttcatttgccaacttccttgcataacaaaccagtttcattagcattgaaaacctgttcttccacaggactcttttaaaatatcactcagcaggtattttaaaaattcttccagatctgcagaacatgcctcacctgcaacttgatgtttttcactccatgtcaccttctgaaacacgcttgctgaccagcagtggctgagaagggtttaacaatgttctaatcctgtatcatgtgactggaagtttcttgggctttcagcttcacagtgctgtctgctatgtttggttggttttgttaaatgggtcgtcatctcaggaatccacaaatgtagccacttctccatagcttcatcacagattggcagtcttcttcctttttctggatggactgtattgttaactcattcatgctgagctcacagccaacagcactacaactcatgcctgaatcgaagcctatcaaaggcccatcccagccttcctgtgccaaggaatgctggacaacacttcagcattctgcatggggccattttgaacaggcacagtggctcacacctataatcccaacactttgggaagccaaggtgggcagatcacttgaggtcaggagtttgacaccagcctggccaacatggtgaaaccccatctctactaaaaatacaaaaattagctgggcgtagtggtgcgcacctgtaatcccagctactagggaagctgaggcaggagaattgcttgaaccccagagtgcagtggttgcagtgagccgagattgcaccactgcactccagcctgggtcacagagcaagactctgtcttaaccaaaaaaaaaaatcaccaccaagaggcacaaaaatgtgaaaaatgtggcactaagaccacaaaaaggacactgatttacaatatcagagcaaaacaagaaggcagggtgtccccttgtttgacttcatctgcgaacgtgcgtgttaggtgataaaaatttttgccactctgtgcgtacctgcaaacagctgcaaaagtgccaggagcactgattttggagttacgagtaaattttagtgagtagttgaattcacaaaatggagttcatgaataatgaggactctctagatgcaattcctgatcaagataactttttaaagatgatcgcttccttttttttttttttttttttttagtgttaccattgattagaaaatgtgtttgcaggccgggcatggtggctcacgcctgtaatcccagcactttgggaggctgaggcaggcagatcacaaggtcaggagatcgagaccatcctggctaacacggtgaaaccccgtctctactataaataacaaaaaattagccgagcatggcggcaggtgcctgtagtcccagctacttgggaggccgaggcaggagaatggcgtgaacccccgggaggcgaagcttgcagtgagccaagatcacgccactgcactccagcctgggtgacagaacgagactccatctcaaaaaaaaaaaaaaaaaaaaaagggaaatgtgtttgctcaagtaggtgggaacaaacaggagactgtttatccctattttttaaacattttctgttcttgccattaactagatttcagataatttaatctatttaattcatagttctaagcaatagtctagtctttaaatctaatagcttttcttttcattcacaaattgacattgtcctgtgatattgtcaatgaattctgagtccagtcaaacttttccatttcaaatcatcactaaccaaaagaagcagaatttcagctacaaatgcaatcacatgtcatttcaaattttgtagtagcacattgcagtaaaaaagaaacatgtgaaactaacattttaacatttaatttcacccaacacgaaatatcattggaaaatgatgtgtgttttgcagtatgatcagcgtgaaaaatattagtgaggtacttaacaattttctgtactaagtctttgaaagtttctgttgatggcaacatctcattcaggctggtaacattaacattaagtgctcactagccacaatgttactacctcattgaacagtatttcaaaaataacactcaagccattcctcaagtacacgtaaatattattctagtaactataattttttagaattaaatttatattaataatgctgactagtagctactagtaaaaaattcctaaactcacttttccaaagttaaatttttgctttaaaagcatacactttttcaatacacatttgtatctgtacatacatatgagatattttcacatgatccatgcagtattcttttctttctttccttctttcttttattttctttcttgttttttgtttctgtttttatttttttggagtcagggtctaactcccatagcccaggctggagtgcagtggtatgacatgatcttggctcactgcaacccccacctgccaggctcaagtgatcctcccacctcagcctcccaagtagctgggactataggcgtgcaccactgcacctggctaatttttgtctttttaaaagagatggagttttgccatgttgcccagactggtctggaactcctgggctcaagctatctgcctgcctcagcctctcaaagtgttgggattacagacatgagccactgtgcttggcaatattaattttaaaaaaattttttagagacatagtctcactctgtcacccaggctagaatgcagtagtgtgatgataggtcacttgcagcctcaagctcctgggctcaagggattctcctgcttcagcctcctaagtaggtaggactacaggtgcacaccaccacacctggctaatttttttaatgttttgtggagatggctaatttttaaaattttttgtgaagatggagtctcactgtgatgcccaggatggtctcagactcctggcctcaagtcatcctcccgcctcagcctcacaaagtgctgggattacaggtgtgagccaccacgctccgcctccctaatctttactgtattacctactgggcaatgtaagtgattttttgactgccagtctagggagtcagatgactgcccagcttgtggtggccggcctccaagaccatcccatgatccctgccttctgttcttcagaccctgtgtaggcccttcccacactggatcagacttgctctgtgtgaccagcagacatggggaaggaatggtagaagaaactaggtcataaaagacagtttggctttcatcttccccctctcttggttcactcactctggaggaagccagctgcagtgtcttgaggccacccaaggagaggccctcttggctaagagctgaggcctccagccaccagctttctgtccccagatgaccgcagccccagctgacagcaagatggctcacgagaggccccgaggcggaactacccagccaagctactctcattcctgatctacagaaactgagaaaataaatgttttaagccaacaaagtttgaagtaacttgttatgtagcaataagttactaacatacagacttaactttaaaagttatatttagttgggcacagtggctcatgcctgtaatcccagcactttgggaggctgatgtgggcagatcacctgaggtcaggggttcgagaccaacctggccaacatgggaaaccccatctctactaaaaatacaaaaattagccaggcgtggtggcaggtgcctgtagtcccagctacttgggaagctgaggcggaagaattgcttgaatccaggagggggaggttgcagtgagtggagatgacaccacttcactccagcctgggcgacagaatgagactccgtctaaaaataataataataatgttatatttagatataaagaatttaagggactaaagagtttccacagttttttttcaaacttttgaaatttgatatttcaaaaaataaatcttggccaggcacagtggctcatgcctgtaatcccagcgttttgggaggctgaggttagcagatcacttgaggtcaggagatcgagaccagcctgggtaacatggcgaaaccccatctctacaaaaaatacaaaacactagccgagtattgtggtgcatgcctgtagtcccagcaacttggagagagacaggaggttgaggccacagtgagccatgatcatgccactgcactccagcctgggtgacagggtgagaccctgaatcaattaatccatcttacatcagccacttcttaggaatgctttaaaccaactcaacctttttagattaagcatagatgagcgaaatacaatatggaaatattagttttacttaaaattctgaaaaagcaacaaaatattatattcatgtagagtcaattgtgaaaaaaactgattcctgaagccacaaagtctacacctttattgtatcaactttatgttcaattaatatttttaagaatatttctatgattaaaaattaattataaatcctatcaagaatcaaacttactaaatgttaactttaaaagccagtaagatctacaacacagatgaaccttgaaacatactaagagaggctggttgtggtcgctcatgtctgtaatcccaggactttgggaggctgaggtgggcagatcactggagcccaggagtttgaaaccagcctggctaacatggtgcaaccttgtgtctacaaaaaaatacaaaaaatgagcagggcatggtggtgcacccctgtagtcccacgtacacagaagactgaggtaggaggatcacttgagcccagggaggtcaagactgcagtgagctatgattgcaccactgggctccagcctgagcaacagagcgagaccttgtctcaaaaaagaaaaaaaaaaaaaaaacccactacgtgaaagtcagtcacaaagggccacatcttactgtttcatttatctgaaatgtctagaattggtaagtctatataaatggaaaacaggttagtggctgcctagggatgaaggcatggaaggaaatggggaatgactgctaatggctatggggtttgttttaggggtgatgaaaatgtcccaaaatagtggtaatggttgtataattctgtgaacatactatcaatcattgaattgtatactttaaatgggatttaattcacattacatctcaataaaactattttttaaagaagaaaatgttcaaggaacaagggttgctaaataacagaggataactgttgtttgacaacagcacaaaaattatttcccaaaaagtgtaatggccctggaaaatgagtgcaacgggatcttctcttgaacctggatagcggggtgtggacagctgggcacactgaaggcggtgatacagaactaaaagcaacaggacagctatgaagggaaaagaaaatcagtgtggctaccaagacattttagtgtctgctttcaagaaggtcctccccccatgcttggctcatgatatggggtgagtctcttgttagagtggaacatataggtcagtgtaaagtgtggagaccagcacctgactctgagcaagagttccatgaatattagctttctatttttaaaaacccactaaaagtctgggcacagtggctcatgcctataatctcagcactttgggaggctgtagtgggtaggatcgtttgagcccaggaatttgagaccagcctgagcaacacagtgagaacccatgtctaccaaaaatttagccaggcttggtggtgcacacctgtagtcccaactgctcaggaagcttgaacccaagaggttgaagctgcagtgagccgagatcacgccactgcattccagcctggccaacagagggagcctgtctcaaaaaaataaataaataaataaataaataaataaataaataaataataaaaaaatatgaagccactaacaaaggagggtaggaaatagttaacaatccagttatattctctttagagacacgcaataccagataacaaaaacaataaagatggctatcttagtcccttttctgttgctataactgaatgcctgagactgggtaaattgtaaagaaaatacattcatttcttacggtctggaggctggaagttcaaggtcaaggagctgcatctggtgagggccttcttgctagtggggactctctgcagagttccaaggtggtacagggtcacatggcaaggagtacacaagagaatgccaagtggcttttataacagactcagttttaaaataactaacccattcccatgataacccattaatccattaacccattaatccatgatatattaatcctttggtgaggacagagcactaatgacccaatcacctcgtacaggctccacctgtcaatattgttacatttgggattaagtttcatcatgagtttcagaggggagaagcattcaaaccatagcaaactcctatgatggtagaaaaataaatataagagcaaactgtaccaaaaggaaactaagctttatatatgcttctatagtttgaattatgtgtcctcccaaaatttatatgttgaaacctaatcaccaagatgatggtattagaaagtggagcttttggggaggtgattgggtcatgagggctctgtcctcacaaatgggattaatgaccttataaaagatatataagggagctgcttccctcctttttgcccttccaccatgtgaagacaaagcgtccatcccctctggagggcaaaacaacaaggcatcatcttggaagcacagaccaggccctcactagacttcctagaaccttgaccttggactttctagtctccagaaccacaagaagtaaatttctattgtttataaattacccagtctcatgtattttgttatagcagcacaaatggactaagacatgcaggcaagaatttatgataggccgggcacggtggctcatgcctgtaattccagcactttaggaggccggggtgggaggatcatctgagatcaggagtttgagaccagcctggccaacatggcgaaatcccatctctactaaaaaacatatatatatacaaaaattagccaggtgtggtggtgcacacttgtaatcttagctactcaggaggctaagacaggagaattgcagaattcttctgcaattcaggaagcagaggttgcagtgagctgagatcgtgccactgtactccagcctgggcaacagagcaagactccatctcaaaaaagaatttatgataaacaagtcaggctatccagatgcaagggctcatgcctgtaattccaggactttaggaggccaaggtaggaggattgctctagcccaggagttcaagaccaccttgggcaacatagcaagaccccacctcttaaaaacatatataaaaataaaaaattgtccaggcatggtggcacagacctgtagtctcagctacaaaggatcgcttgagcctgggaggtcaaggctgcagtgagccattatcatgccactgcattccatcctgggcaacagagcaagacactgtctcaaaaaagaaaaaaaaaattcaggctaaataatatattagaccagttgaaagggatcaatagaaacattaaagaaagattctatagtgggttagttctgcagtgtcccctcaaaattcatgtccacctgccatctcagaatgtgcccttttggtaatagggtctttacagatgtaattagttaagatgagattatgctggaagactaatgtccttataagaagaggagaagggtcaggcatggtggcttatgcctgtaatcccagcactttgggaggctgaggcgggtggatcacttgaggtcaggagttcgagaccagcctggccaacatggtgaaaccgtgtctctactaaaaatacacaaattagctaggtgtagtggcaggcgcctgtaatcctggctactcgggaggctgaggcttgagaatcgcttgaacacaggagacggaggttgcagtgagccaagatcatgccactgcactccagcctaggcgacagagtgagactgtctcaggaaaaaaaattaaaaaaaaaaggaacaggagaggagaagacatacacagatgctcagcagagacagcagccatatgaagacagaggcagacattggtgtgatgctgccccaagacaaggaatgccaaagattgctagcaaccaccagcaagtggaagaggcagggaaggattctttcccagcgcttggagagagagcatggtcctgacaacattttgatctcggacttctggcttccagaactatgagagaatgaagctctgcacctgtatttggtgtttagttatggtgaccgcaggaaactgatacatatgccatgtagtgcagccactcaaccacaaggggcactgtctggcagcaagttctacaaacacaaactgtccaaaataatcactgaagttcacagagaaagccatacaaatagcattcaaatatttttaacgatgatcaacaggctacaatttatcatttttaaaaacataaaaccattatcatcttgctgaataattcatgacctttgtaacaaactggctgagaaccacttttaaagaacatcctggtccggctatcattacacacacgggagggtatctgtaggataaattcccccaacaattccctttccaggaagagacgcatatttttaatttcaatagacaacagccaaattgccctccaaagaggaggtacattacactcgccagaaatatacatgaatggctggttttccccaggcttggcaatactttgccaagctaagaggtaagaatgggctttaaaataaaccctgatccagctcccaaggagaggactggggccttcggacccacatttcccagcacaggtgcttcaccagcctgccatggccccttctctgtccagtttagcaagggtgtggcagatttcctttcaggcacagagcccagccttccagacatcacacttaaactggttcctaccacatttgcaaggagaatctcttcttccaagtcagcagtgtttacaataagcagtatgcttttccctgagtcactctgaatatagagaccagaaaccaattccagggtagcaaagggacagccaccatggtgacctcaagcatacaaatcacacacctgcttgtcctgcctggtcaagccctgttgggaccatgcataatcctgaccccagcactcaggcacagaacacttaggagaggaaggcgaggtttcagctacatgaggtggcattgtaggaattgtcttctccctgacaccccccatggcactcaacagcctcactgtcctgaccctaagccactttgtgacccacccctgggaagggcaggcagtgaagaactaggcatagagaagaggaggtggggagttaccaagctgtttgctgacctcttcatttgactcagaacctgaccttaatcttgcttccagaaaaacaatgggccccattcctgcccaagcttgccttctgcaacccagactttcttagaacgcgatgggagtcaagagcgctttctttaaggcgaagctgtagacaggttcccctcacctcccacctctgcccacattatctgcctctagcaaataatggtagtcatgactgtgcctgttacccaggagaacaccaatcaatggctgtaaagacatgaatgtatggttttagatggtgtctgcctgcctttgctgaaaaaatgtaagaacagcaaacatttatgtattaccgtttgtcagtactgctctaagcacttttataatattaaacattcatgctgtactccttacagcaatcgtaagagctaggcactaaaactattcccattgtacagatgagcaaactgagacactgagagattgggaaccttgcccacgatcacacagtgagtaagtaggagctacaataaggagccatgaaggcagggagctccactcctgcccttcccaggcctctgttcactcctgagcatgactggtacctaacaggtgctcagacagtcgctggatgcagatgagggaacggctgtggacattcagtccttcagaccacaaaaggactttggaaggagaagaaccctggaagaatgccatgttactggcaaaggtttgggttcttacccagtgatttggtaaacacaaagggacaatggcattaagtgatagcaaagccaatctaaacagaatcacagcagtaaaccaccagaacccacaactttttttttttttttttttttgagacagagttttgctcttgttgcccacgctggaatgcaatggcgccatctcggctcgccacaacctccacctcccgggctcacccaatcctcccagctggaactaccgcacacaccaccacacccagctaatttttgtatttttggtagagacagggtttcactatgttgcccaggctggactcaagctacccacctacctcagcctcccaaagtgctagaattacaggcatgagccaccatgcctggccaccagtattttgccaggctggagtgcagtggcacaatctcggctcactgcaacctccgcctcccgagttcaagcaattcttctgcctcagcctccctgagtagctgggactacaggcacgcaccaccacacccagctgatttttgtatttgtagtagagatgaggtttcagcatgttggccagattgttctcaatctcttgaccttgtgatccaccctcctcagcctgttgggattacaggcacgagccactgagcccggcccagtctttttcttaaaaaatctgctcacaattccaattatttgcgcaatgctgtactaagtacaagagaaaggtgtttcctctcagccaggacagaaggtaggaatcttcctgtaactgcagtcctttctatggccactaaaacaaattaccacaaactgaggggcgtgagataacacatgtttatgatcttatcattctggaggttagaagtcctaaagtcaaggtatcagagccgtgctccttccagaatccctgagggaggaacccctctgctgtcctgtcaacttctggaggctgtctgtgttccttggcacatgcccttcctccatctccaaatctctcctgacctctgcttctaccacatcttcgtcttggacccttctgcctccctctcataaagacccttgggtctacactggacccaccttggtaacccaggctaatctccccacatcaagatccgtaatcacttctgcaaagtccctcttgtgaaggaaagcaaattcacaggctctgcagattctaatgcagacctcttgggggaggggcattattctgtcgacggcaataaccggagccatttctttctttctttctttctttttcttttttttttttttgagacaaagtctcactctattgccaggctccagtgctgtggtgtgatcttggctcactgcaacctccaccccctgggttcaagcaattctcctgcctcagcctcctgagtagctgagactacagatggacgccaccacacctggtttttttttgttttgttttgttttgtttttttgtttttgagacagagtctcactctgtctctgtcacccaggctggaatgcagtggcctgatctcagctcactgcaagctctgcctcccaggttcacaccattctcctgcctcagccctcccgagtagctgggactacaggcgaccgccaccatgcccggccagttattttttcgtatttttagtagagatagggtttcaccgtgttagccaggatagtcttgaactcctggtttcaagtgatctgcctgccttggcctcccaaaatgctgggattacaggtatgagccacaggaaaaaaaaatcactttcccaatctgcaaaatggctactgtcctcaatttccccaaactaatccctctcaatgatgacctcaaatctctcaccctccaaagagataacagatgccctcaggaaggccttagtttccccaacatgcttgggtctaaacccacacactctgcctttccttctgttacaagagaagaggtgtgctgtttccccctccacacccccacctgattcctggatccacccgtgcttggtcttcccacacattttgttcttgcaattcttcctgttcttcaactgttctctctctgagattattgtcattacataaaaacatgctttaatatctctctcggcttttgaaattctttaaaaaggagttaagttgtgcaatgtgagttcattgaccacaatggatttaagttagaaatcaatcgcaagatagccggaaaaatccccaagtaagttggaaacttaaaaaatacacttctagccaggggcagtggctcacgcctgtaatcccagcattttggaaggccaaggcaggcagagtgcttgaggtcaggacttcgagaccagcctggtcaacatggtgaaaccccatctctactaaaaatacaaaaattagctgggcttggtggcgggtgcatcccagttactcaggaggctgaggcacaagaatcgcttaaatccaggaggtggaggctgcagtgaactgagatggcaccactacattccagcctcagtgatagagcaagactctgtctcaaaaaataaataaataagaataaaaataaaaataggcggccgggctggagggccctgccaggggtgggggtgggggtgggtgcggggagccccgcggcgggggcgggcgcggagtcacgggggtggggtcactcgcggtggctcggggaggccagctgggaggggagggggccgtgggggcggctcggctgaaccagccccggctgggcagcagcggggacgccgggggccggggccagggctttccgggcttaggtgaggccgccgtgggccccatcttccggcggtcgccggagtttgtggtgattgttgctgccgccgccacccccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacccctgtatgaccttcgtattgaccaaaagatttacggagaactatggaagacaggaatgtttgaacgcatgtctctgcagacagatgaagatgaacgcagtattgaaatgcatttgccttatacagctaaagccatggaaagccataaggatgagtttaccattattcctttactggttggagctctgagtcaaaagaacaggaattcggaacttttcagtaaatatctagcggatcctagtaatctctttgtggtttcttctgatttctgccattggggtcaaaggttccgtcacagttactatgatgaatcccagggggagatttgtagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccgggctcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttatggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaataaataaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattggtaaacctctagccagacagatcagaaaaaaacacgaaagacacaaaccagtctcagaaatgacaggtagcatcattaccaacattaaaaggataagggcatgttaaaaggataagggtatcaatagaatcaacaccttagatgaaatatataaaaaatttgagctctttctcagtgaccagggcctgtgcttaggcatagacgggcaagtggagccaacatgccagcggcccagagctgggtttgttgccaaacttatgtgaccctgcagagacccttcgagaaacctcatctcgaccaaaagctaaagctgattggtgagtatgggctccagaacaaatgtgaggtctggagggtcaaatttaccctggtcaagatccataaggccgcccgggagctgctgacgcttgatgagaaggacccacggcgtctgttcgaaggcattgccctgctgcagtggctggtccgcactggggtgctggatgagggcaagatgaagctggattacatcctgggcctgaagatcaatgatttcttagagattcctacagacccaggtcttcaagcttggcttggctaagtccatccgccacgctcatgtgctgattcaacagtgtcatatccgtgtccgtgagcaggtggtaaatatcctgttcttcactgtccgcctggattcccagaagcacattgacttctccctctgcttccctattggggtggccaaccccagccacgtgaagaggaagaatgccagcaagggccagggtggggctggagccagagatgacgaggaggaggaataagcctgcttgtcccctcctgggctggtggattgtctagttttcctgccaaatgataaaacaggatcaatgctttatttaaaaaaataaaattatgaaaaacagaaattaaggtcactcaagaagaactaggccaggcacggtgacacaagcctgtaataccagcactttgagaggccaaggagggagaatcgatgtagcccaggagttcaaccagtctgagcaacacagtgagactcccatctctaaaaacaaataaaaataaaataaaataaaaaattatccaggcaggccgggtgtggtggctcacgcctgtaatcccagcactttgggaggccaaggcgggtggatcacgaggtcaggagttcgagaccagcctggccaacatggtgaaaccctgtatctactaaaaatacaaaaattagctgggtgtagtggcagcgcctgtaatcccagctactcaggagcctgaggcaggagaatcgttggaacccaggattcggaggttgcagtgagccaagatcgtgccactgcactccagcctgggtgacagagcaaaactccgtctcaaaaaaaaaaaaaaaaaaaaaattatccaggcatgactgtggcacacttgtagtcccagctactagggaggctaaaggggaggatcacctgagctcaggagactgacgctacagtgagccacgactgcagcactgcactccagcctgggcgacagagaagaccctattaaaaaaaaaaaaaaaaaaaaaaaaaacagaaatagaaagcctaaatagccccatatccttaaaacaaggttccaaatgatctttttttttttttttgaaaagtctcactctgttgcacaggttggagtgcagtggtgcaatctcggtttactgcaacctccgcctcccgggttcaagcagttctcctgcctcagcctcctaagtagctgggattacaggcacgtgccaccacacccaggtaatttttgtatttttagtagagatgggggtttcaccatgttggtcaggctggtcttgaactcctgaccgcgtaatccacccgcctcagcctcccaaagtgctgggattacaggtgtgagccaccgcgcccggaccaaatgatctttaggagaaaaaagaaggaaatactgggggaggcacagtaggagatcacagcaggggcccacctccggaacctcaagtaaggacttgagagagaaggtagagtcagagtaacagagacacaggcgggttagccagctctgcatggaaaaggctgagtcgtgatgatgtcatggttctccccaaatctcaaagtcactgatcaaacaactcagtttacactgaagacgatggatgagactctaattttgtgcccacagcttgacacacctttgggaatttggtttaactttctttgccggtacacagatctgtgagaacatatgatcaatccagatctttatagatctatatcctccctggacaaacctaaatgcagacacttttagcacccgtaggagttaggtaggattaaataaaaacattccctcccacttgggggcacattcactgggaatcccagagcgatgtcgcctgcccacacctgctaagtgcgctcacagggcatctagttccctctcttgagttccttttaagcaagcaaggcaacctatgtccagagaagcagttactgtgtctaagtaagtcactgcatcttaggaaaaagcaaacattcgcattttgcagtgcatgatgggcgcacacccaagaaaattactcagcacttgtttttctcactttggggttttcccaaaataatttcttcagtccagttgccaagaatctggagcccccgactgacccatcaaggtccgatttggcttcggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaaggaaggaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaaccttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcctcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaaagttctgggatttcaggcatgagccactgcacccggcctttttttctctttcttttctctctctctctctcttttttttttttttgagatggagtttcgctcttgttgcccaggctggagtgcaatggcatgatcttggctcaccgcaacctccgcctcccaggtttgaatgattctcctgcctcagcctcctgagcagctgggattacaggcatgtgccaccacacctggctaattttgtatttttagtagagatggggtttctctatgttggtcaggctggtctcgaactcctgacctcaggtgatccacccgcctcagcctcccaaagtgctgggattacaggcatgagccaccacgcctggcctctttctgttcttgaaaaggaatgttcataagaatctccctgggagaaacgtgtctagttctggaatctggagctgaacaacattgctatgcccaactcttcagcctgagagggagaagaacatagtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagttttttgattctgtaagggtgatgctttatcctctatttccttagctctgcaagctttctttgcatctcattctgttttgagtatatttttattggttgttttactttttttttgcttgagacagaatctcactctgtcgcccaggctagagtgcagtggcacaatctcagctcactgcaacctctgcctcctgggttcaagcaattcttctgcctcagcctcccaaatagctgggactacaggcgcccaccaccatgcccagctaatattttgtatttttagtagagatggggtttcaccatgttggccaggctggtctcaaactcctggcctcaagtgatccgcccaccccagcctcacaaagtgctgggattacaagcatgagccaccacacccggctggttcttatacttacaaagtagcagagcttgaaggactcaggaggaatatcttctttaactgggacatgatttcttctagatttttcagctgggttttgcattctgcattccttcccagaatgtttacgaggttgcccagccaccgcaactgtatctctttactgaaactcatgcagatgtcttctccttaacctatgcacactccctgtgaactacagcccagggtgattcttcagtaactccctaagcctttttttttttttttaatttgagacagtgtcttgctttgttgcccaggctagagtgcagtggcacgatcatgggttactgcagcctcgacctccagggcaagagacttccatgactaaaacctcaagtgatcctcccacctcagcctcctaagtagctgggactacaggcatgtgccatcatgcccaaataatttaatttttggtagagacagggtctcactatgtttcccaggttggtctagcactcctgaactaaagtgatcctcgctcctttgcctctcaaaacgctgggattccagacatgagccaccgcacccaccctctttcataatttttttttttttttcagacagagtcttgctcggtcgcctggctggagtgcagtggtgccgtcttggctcactgcagcctccacctcccaggttcaagcaattctcctgcctcagcctcctgagtagagtggctgggattacaggcgtgcaccaccatgcctggctaatttttgtatttttagtggagatggggtttcgccatgtaggccaggctggtcttgaactcctgacctcaggtgatctgcctgccttggccttgcaaagtgctgggattacaggagtgagccaaagcctcttttataatcattatgacaataggtgagttcacattctctgctttcaaatgggattggttttgcaacaggcctcctggcttctggttacaccttgtagaaaaaagtcttggagagcaaggagtcttctgaaatagaagaaatgtactcgcaaaggcttgcaagagtgtcaaggcttcggcaagaaggctaatcacacaaaaaaattcagtggaatttacattccggctggccacagtggctcaagtctctgatcccagcactttgggaggctgaggcaggaggatcacctgaggtcaggtgtttgaaaccagcctgggcaacacagcaggcctccatgtctgcaaacaaatcaaacaaaacttagccagacatggtggcacacacctgtagtcctagctacttggtaggctaaggtggaaggatcagttgaacccaggagttcaaggctgcagtgagctatggtcgtgccactgcactgcagcattctgggtgacacagccagaccctgtctctacttaaaaagaaaacgaatccattgaaagatggaaaaaaaccaaagggaaataactacaaatttgccaaggttaccaagtttatgataggctgctcactgtgtgaaattagaaatgttgtcacttgattatcaaacccacaaatgtcacatcatatcccctgacataggtaagcactgcagtcataagagataatgccgtttttccttagggaatcagtaaagtatgggaatgctcaagtttcttttatttgggggaactgaactgcacaggatgacctggttatttctggttcatcacagtatgtagctatttgtttttcttaactctctgatttacaatggcagcacctcaaagtgtcagtttaactctcacagcctgcacccactttttcatccacttggggtagggggaagtctgaatcccacctagactgcatttaacatcttgaggccagatggagtggctcatgcctataatcccagcattttgggaggccaaggcaggcgggttgcttgagcccagaagtttgagaccagcctggacaacatagcgagacccctctctacaaaaattcaaaaagatcaggcagacgaggtgcacacctgtagtcccagctactcagaggctgaggttgggaggatcacttcaacctgggaggtcaaggctgcagtgagccatgattgcgccactgcacttcagcctgagtgacaggacaagaccctgtctcaaaaaaaagcctaaaacaacaacaaaaacttcctttagcctatttgtatgtcactgattaaatccaacatgctcttatggtattcatctcaggctacagctcctaagacattttaatgtctcctttcctggctctaaaaacaatttaatggctttcaatcagcttcccgagtatcttttgtactctcgcctccctctgcagccaaactccagtcctgctaatgccgggcaatagcccaggaaccacagagcacttcaggctctgcctgacaaagttacagacaggaagttcagaagaaatgagccagtcccttttatttcttcttcctcttttgtctctaaccaatcctttttggataagtgtgtaacccacttcctcttttgtctctagccaatccttttaggataagcatgtagctcatttggatgacccttaactgtcaactgctggtcagaatgacatttctcattcttagagaagggctgccattagcccttattggatggtctgcccagcaccctcttccaaaatatgatctcctgccctcccctgccccctgcttccttcccatgtttgcagctgcagctgccacaaggtgaccttgcctctgttgactgctccagctataggtttttcctctaaaaagaaccagctggattggatcagagttgttactgtgcatctcaccccctgtgcctgaggagcagagggagccagccattgccagagaaagaggccaaccatcaagaggagcatttaagccaggtgtggtggctcctgccagcacaatcccagcactttgggagatcaaggcaggtggatggcttgcgctcatgagtttgagaacagcctgggtaacatggtgataccctgtctctacagaataatacaaaaattagccaggtgtggcagtacatgcctgtagtcccagctacttggggagctggggcaggaggattgcttgagcctgggaggtgtttacagtgagccgtgtttgtatcagtacactccagcctggatgacaaagcgagaccctgtcttggggaaaaaaaaaaaaaaaaagaaaagaaaagaagtggcccaaagagaaactcccttccctgtcctcagatcattcctgaaatcttgaattctcagagatgctccaagatacccttgtatccttaaaatatattttctttttcataagctatattgaattgggtagttgttgcttgcaatcaaaaggaacctaactaatagaagtgcattaacatgttttatagtattgtgaaaggaaaataaatcttggggccccaaaatcactaagctaaagggaagagttaagctgggaactgcttagggcaaacttgccttccattctattcaaagtcaccactctgctcactgagataaatgcatatctgattgcctcatttggagaggctcatcagaaactcaaaagaatgcaaccatttttctcttacctacctatgacctggaagtcccctccaggcttccagctgtcctgccttcacctggagctgtcccacctttctggattggcccaatgtacatcttacacatattgattgatgtctcatgtctccctaaaatgtataaaaccaagctgtgccctgaccaccttgggcagaagttctcagaacctcctgaggctgtgtcatggttgcccatcctcaaccttggcaaaataaactttctaaattaactgagacctgcctccgatgttgggggttcaccctatgctgtaggaaaaaaaacaattgggcttggaatcaaaaggagaaaaaaatcatgaattgagaacctatggcaaattagaccatatgtcctgcttaatgctttcccaacatggttttaggtaattctgactatagtcctttgccttagttcattttgtgttactataatggaatatcacaaactaggtaatttataaagaaagtaaatttgcctgtgcacagtagctcatgccaataatcctataactttgggaagccaaagtgggagcatcacttaaggccaggagttcaatgccagcctgggcaacatagagaaaccctatctctacaaaaaataaaaattgaccaagtgtgatcatgctcacctttagttctacctacttggtaagttgaggtgggagtatcacttgtgcccaggagtttatggctgcagtgagctatgatcatgccacttcactccagcctaagcaacagagactctgtcacttgtctcaaaaaaaaaaaaaaaaaaaaagtaagtttatttctcacaattctggaggctgggaagtccaaaagcatggcactagcatctggcaagggcctgcttgtgtgttctaccatggcagaaggcagaagggcaagagaatgctcacaaggtgcaaactaaactcatccttctatcaggaatccactcccctgataaaggtattaatccatttatgagggcagagtcttcactcatgatcttaaaggttccactttgcaacactgttgccttggggattatgtttctaacacatgactttaggggacacattgaaaccactgtatcctttaaggtaggaatcaatgtcatatttgtcatatttcgaacgaagaaataaaggtttggagaggttaattaacttgcccaagatctcagagctaaagccaggatcatatctaggactgactacaaagtcctgtggtctccagtgcttggcaggtccagcttcactgatgagtctagagagtagtaactctcttggtgtaagaactaagggagatgatacattaaatctaagtgtaaattagattatgcttaaagtataagtcatatggttattattaatagatccccaagttagcctatatgtgaacttttccatagagaaatgaagcatggtttcaatgcagcatattttaaatggattatctcatacaatgtgttttttgtttgttttatattgtttttgttgttttctgagacagagtcttactctgttgcccaggatggagtgcagtgacatgatctcagctcactgcaacctccaactcccgggttcaagtgatcctcctgcctcagcctcccaagtacctgggagtacaggtgcatgccatcacacctggctaatacaatgtgttttttttagacaccagagggagccagtggttctttccacatcagcttttctgtgaaacatttttcttttttttgaaatggagtttcactcttgttgcccaggctggagtgcagtggcgccacctcagctcaccgcaacctccccctcctgggttcaagtgattctcctgcctcagcctcccgagtagctgggattacaggcatgagccaccaggcccagccttgtgatagatttttctagactgttgcatgtgtggtacacccacatacaatatcagctttagactcaaccctttgactttgccttcacctactgaacagcaacaaggattgtgacagaccaagaatctgaagaaggatgcagtgtggagacgaaacaggtgtcaatgacaaaggtttagttgttatttcaagtcaactgcaaagtggatgcggtatcaagtatagaaactgcacaggacttctccactaagaacatggggagggcaaagggaatggatgttttgagaaaggaggcagaagccaacagagaacagtggttattaccaagatgggtggagtagaagttagtttatagaagacattggcttaggcctggtgcggtggctcacgcctgtaatcccagcaatttgggaggccgaggctggcagattacttgagggcaagagttcaagaccagcctgaccaacatggtgaaaccccatctctactaaaaatacaaaaaattagctgggcatggtggcgcacagctgtaatcccagctactcaggaggctgaggcagaaaaatcgcttgaacctgggaggcggaggttgtagtgagccaagatcacaccactgcactccagcctgggcaacagagctagactccatctcaaaaaaaaaaaaaaagaaagaaaaaagaagacactggcttagagggtcaccaatatctgcatatcaaaactaagaatgaatttacttggccaatctctctactgggtgatcagcctgagccagataatgcagtgggttctgatttataatgccttctttactgtcaagaggggtaaggattaaagttccggtttaaattaaagttgaaatgctttacttggtttgagtattattatgaaaggaccctgaccgtttctgcatgtcttaaactgatgaaagtagctaagtagacttttaagttgtgacaagacaacttgatccaagaaaacatatttcttgtcagaatatgcaattttttttttttttttgagatggagtctcactctgtcactcaggctggagtgcagtggtgtgatcaaggctcactgcaacctctgtctcccaggttcaagcaatcctcctgtctcagcctccccagtagctgggactacaggtgcacaccactacacccagctaatttttgtatttttagtagagacagggtttcactatattggtcgggctggtctcgaactcctgacctcaggtgatccacctgcctcggcctcccaaagtgctgggattacaggcgtgagccactgcgctcggccagaatactcaaatctcaatgttgtacatttactgtcaatcctgtcagtatcagtatattgtatacagtatacagtaattgacagtatactgtcaattataaattgagttttttaaattatgatttacaaatgaatttgtcaaaattaaattaaacccccccacacgcacacacacctggaatcctttacagataggtggtatatgaatacaaggcacagattgtatgtgcatggtggctttggcacaaacagactacttcttttttcaatgttaagtgtaaagcagttctttcatctctgttcagtgcagtgttgagtgtgactaggatttgaagaacctaaaaaaaaaaaaaactcacctgcttgccatcttcttgttttttttttgttgttttttggtttttgctggttttgtttgctgcttttgtaaaaccagtttatcatattctcattaggaaatcaattttcatgaaattaattttttttcctgctaactatggctcaatcttttcgtttctctctgcttctatcttaagaccattcctcaaattgaccatgagaggatttacatctggggcacttggtatatgccaaatggagacaaaatcagaatcagcagcctggctgggccacaggtccagcatcccaagctattaaaatattcttagtgtttccagggaagtgatagatccactttggaagctgataatatacccctcccctagaaacatgcatatacacaaagtgttctaaacaacttccaggtgctcatgacctcccccacctcccaagctcattgaccactgcctcgccttcacgaactccagacctggtctgaacatttctaaaggacgctcgggagttaaaaggagcgaggccactgcagaaatgacagccttcatccacaagtggcccacttcgggttggctggagccacagctgggtggggacagggcctgtgctcaggtgagcactgcctaccgcgcaccctccaggtgcgtcctaccctgaagcggtcggactggaccgtctaggtcccagcgctcgagaggatggcaggcaggggctggtgattgtctggagatatgaatgctttctaaggttgacgtcaaggtctccttcctgagccacagtccacgtgataagctctgtccaggtagaaatgatctcacctctcctgtcgcccagggtcggaaacctgaggcccgtgcgggctggggcaacttagcaggggtcccaagcccgccgcgccccctgcgccccaaacgtgtgtggagggcttggacgtggtccagagggaaaagatggggtgaaccaggtgccgcgcacccttcgaggagcccccgcttctccgtttctgtgagtgactccaaagcacctccgagggccgacacacgcgcggacgaccttgggcgggcactgaccaatgtccccttccactcggttgtgtcgggggtccccaggtgaggcgcgaacgccgccccgctcacctgtacgaggcctttcccggagcagcccggctacgaagcgacacccatggcggagaagctaaggaagactcccgctccctcacaccgcggctgaggcgactgaaccgccccagtacgccggggccctccccaagccctgctcccaagccgaagccccgcccccgcgtctaaggcccacctccaggccccgcccctgaccccgactccgtgagtcaagcctggcctttcagtccagcccagcccgtcgaggccccgcccctgttgttatggcccgcctccaggcaccgcccttgatcccaccttcatgagtcaggccccgccttccagcctagcccggccagccgaggccccgcccctgtagggacagcccacttccaggccccgcccttgatcccgcctccttcggtcaggccccgtcttctagttccgccccgcccgcggaaaccccgcccccgcgcgcctatggcccacctccaggtcccgcccctgagcccgcctccaggcgtccagccccgccttccagccccgccccaagcgccgaggcccggcttccaggctccgccccgacccgcgcggtggggaagagccgctgccgctggttctccggctcttcctcggcggttctggctcccggccgcgccgcagccctgcccagtctctctcccccagcccggagggctcctccgcgccgcacgtgagcgcgcccgccaacagggccactgccgcggtaagtcgtgcctgcgccctgtccggcgtccagtcctcagccgctgggcgaagccggaggagccgggcatctcctccccgccggcccgcgggtccttctccgggtccagagggcttgggcggcgccgtggggcggcccggggtgcaggtggcttaccggcgcgcggcccgggcctgcggcgcgctctgctgcagtgcgggggcggagagctcggggccggagaccgggagggcagcggggagactgggtggggtcccctagggttacccgaccctggcgcggaggatatgatgccggccacgccctcgccgagcggggcggcaggtgcaggtccaggggtgggtcgcggcccgcgcgccctcccggggccggcccacgaagagacgctcagcctttgtttgctggtgccctggctggggaggaggctggggacgcagacctgtgagaactaagggctttcctcgttggggaagaccccagtcttccagccagtccccaggagaagggatccgggccgcagtgcgcgctctgccagcctggcccctgcgccctgcagggttcccggctgctcgcggggactgttacccgcagtgttgccttacactcgcgactgcagccccacaattgggaagactttgctaggatttttttggtaaggcgagggaagaccgtccccccggccccacaagtctgctgccattaggtggcttaaattttttccagtacaatttaattgccactttgaaagaccacattcaaaacagtgtgtcccagagttgattaagcccattggtgatgagtgtttctgtgctgtggactaaggatcattatcaattttattactaatagtacatatctgttatctgttgctaaatgtttttgcttatgtggtagggtcactgtcctcattttcatcgaactgagaaatgttccttcatatagacatatttacagtgaacttttttgggatctggcagttggtttttctcttgaacttgtttttttctttttctaaattattattattattattattttgagacgaaggtctcattatgttgcccagtctggtctcaaactcctgggctcaagcaatccttccacctcggcctcttaaagtgctgggattacaggtatgagccacagtgcccaaccctgaatttgattttctatgaaattaaaaatgggtaaagagagagatttcttgctgacattttcgattttaaggtatctgagcagatacacttcttgtgtgattacttctttctgtgtctagttatttatagcctgtataactgtcggttttactgaactcttcaatctctcacaggagacatatccaggatagattgcaagatcattggcaaaagagctatttgagaactgaaccaataattttatcagtagcataatgtagtggagacctgtactatctcactgacctgagctcgaatctggttctgctagctgctgggtgtgtgacctgggcaattttccgaatggcctgacttctaatatcctcatcttgggcctaatacccatctcacaggactcgtgtattgcagtaaagaaatgcatgcagccgggcgtggtggctcacacctgtaatcccagcactttgggaagtcgagggggtggatcacaaggtcaggagatcaagaccatcctggccaacatgatgaaactgtgtctctactaaaaatacaaaaattagttgggcgtggtggcatgcgcctgtagtcccagctactcgggagtctgaggcaggagaatcacttcaatctaggaggcgcaggttgcagtgagccgaaatggcgccactgcactccagcatggcgacagagcgagactcttgtctcaaaaaaaaaaaaaaaagaaaagaaaaaagaaatgcatgcataaggccaggtgcagtggctcatgcctgtaatcccaacactttgggaggccgaggtgggcggatcaccttacgtcaggagtttgagaccagcctggccaacatggtgaaactctgtctctaccaaaaatattttaaaaaattagccaggcattgtggcgggcacctgtaatcccagctactcgggaggctgaggcaggagaatcgctggaacccgggaggcagaggttgcagtgagccaagatcacaccattttaccccagcctgggtgacaagagcgagactctgtctcaaaaatcaaaaaccaaaacaaaacaaaacaaaaaagagactgggcgcagtggcttatgcctgtaatcccagtactttgggaggccaaggtgggtggatcacttgaggttgggtgttcgagaccaggctgaccaacatggagaaaccccatctctactaaaaatacaaaattagccgggcgtggtggcacctgcctgtaatcccaggtactcaggaggctgaggcaggagaatcgcttgaactcaggaggcggaggttgtggtgagttgagatcgcgccattgcactccagcccggtcaacaagagcgaaactccatctcaaaaaaaaagaagaaaaacaaatgcatgcataaatggtgaatttaccaagctcacccagaagacttgcttggtagcataccacgtgccccatatttcgaaataaaggagcttgcatgaatgacgatttccaaacttctctcgtgtgctggtagttacaccaaatagcactttcttcatatggccaaccataacactgaactgctccagctactgctcttacctggctgatgcccttcttgccatgagcagtggcgtcccttgccaccccaccttctaaatacacaccttatcgtcaatacacaccttatcacagttctcttcctggtaactctagctgcccacacctctggactttgaggactcctctgccggtggctgagtttcctcttggtatcatcagactctgtcattttgtccaccctctgtcacttatgtgtgttaaaaggagcaaggccactttgtccaccctctgacacttacgtgtcccacattaaactgaaattatgtatttaggtacttccacttttattaggctatgaactatgagagtagggaccttgtcttatttatgtttctttcccccatgtttagacacttagtagagtgaacagactgtgcaccattggagtattgcggtggtttagagatgctgggtttcagaactgaattttctggaaaaaataataataataataataatatggaccattttggatatatcaacttcttagtctttacttggcaaaaggaacaaactaccagctctcattaccatcttttccttaatattttcaaaatgtgtgaaggcagttatttcagaaaaagggacaggccttcccaggattgagtaggcggtcttattttgtgggtgggtgtgcaaggtgcagtatatttttgcagagaggcacgcatatgcagaggctctgtggcaggatgggtccgtcttggggttggagggtgcagtgacaagtgggtagagtcttgtaagctggaaaaggggttgtttggttctattttaagttttcttttttttttttttttttgagacagagtctcactctgtcacccaggctggagtgcggtggcacaatcccagctcactgtaacttccacctcccaggttcaaactattctcctgcctcagcctcccgagtagctgggatcacaggcatgtgccaccacacctggctaatttttgtatttttagtagtgacggggtttcgccatgttggccatgctggtcacgaactcctgatgtcaggtgatccacccgcctcggcctcccgaagtgctggggttacaggcgtgagccactgcacctggccttattttaagctttatggaaacaattttaaacatggcagttgtatgcattgttttaaaaggattcttggagcactgtgtgtaaaggcactggaaaggggcaagtgtgggagaatcattgggaagctcctgcaaacatgcaggcaacaggcagcccacactgcggtgtggcgatggagagcaattgagtcaacaggtgtttaggaagaagaggcaaacaggactggggttgagcatggcaggagaagagaaggaagagtctagaataatccaacaggtaaaggggctactttctgagaaggaaaagatgggagaaggagcatgttgagcagatggaattgagagtttactgttgtttttttttgtgtgtgtgttttgttttttggtggggacagagtctcactatgtcacccaggctggagtgcaatggtgcgatctgagcccactgcaacctccgcctcctggattccagtgattctcccgcctcagcctcctgaatagctgggattacagccaccatgcccagctaatttttctatttttagtagagatggagtttcaccatgttggccaggctggtctcgaactcctgacctcgtgatccacccacctcggcctcccaaagcgctgggattataggcatgggccactgcacctggcctagttttattttttttaacagctttattgcactataatttgcagctcataaaattcattcaagtgtataattcagtgttgttgttgttgtttttgagacagggtcttgccatgttgtttgtgacccaggctggtcacaacctccggggcagaagcaatcctcctacctcaacctctggagtagctgggatcacaggcatgagccactgtgcccagataatttcagtgatttttcatacatttacagagttgtgcaagcatcgccatcatcccattttagcacgtttgccttacctgagaaagatcgccgtgcccagtggccattactccctgttttcactgcaccccaggcagccactaacctacttgccttctctctagatttgcctgtggagggcatttcatatcaatggaatcatacaatgtctggtcttgtgtgtctggcgtcttccactaagcgtgtgttttcagggttcatccaagttgcggcgtatcagtatttggttcctttccattgcctcagcgttcctttgtggatagaccatattttgtggatggatgcttgtcttagttaattcaggctgctccaataaaatagtgtaaactaggtatttctgttataagtgacagtagtgtattcctatagttctggaggctgagaagttcaagatcaaggtgctggcagattcggtgtctggtggggcctgcttgctgtatcctcacagtggaaagaacagccaggctcccttgggtctctttaatttagtttatttgtttgagacagggtctcattctgttgcccagactggagtgcagtggcatgatcatggctcactgcagcctcaacctcccaaactcaagtgatcctcccaactcagactcctgagtacctgggactataggcatgtgccactacaccctgctaatttttgtattgtttgtagagatggggtttcaccatgttgctcaggttagtctcaaactcctggactcaagtgatccacctgctttggcctcccaggatttcagatgtgagccactccgttcagctggtgtcccttttaaaagagcactaatcccatgacataatcacctcccaaagtcttcactttcttttttttttgagatggagtcttgttctgttacccaggctggggtacagtggcgcagtctcacctcactgcaacctccatggctcctgggttcaagcaatgctcatgcctcatcctcccgagtagctgggacaggtgtgtgccaccatgcccagctattttttatgtttattttttggtagagatgggttttcacgatgttggccaggctggtctcaaacatctgacctcaagtgatctgcccgccttggcctctcaaaagtgctgagattacaggtgtgagtcaccatgcccagccgccagggaatgtatttagcagttggtagaggaggaggaaagaagttcagagaggtagatgggaaacaagctctggtgctggaggggccagaggagtgtgtgggccaagtggaggctgctaggctgcttaaagaagtggtctgccgcagagtgctactgagaggtaaagtgaggaaacagaaaggacctctgccattggtgacttgaaagtagtggtggttgccaggcgcggtggctcacgcctgtaatcccggcactttgggaggctgaggtgggcagatcacgaggtcaggagttcaagaccagcctgaccaacacgtgaaaccccgtctctactaaaaatacaaaaattagctggacatggtggcacgtgcctgtagccccagctatttgggaggctgaggcaggagaatcgcttgaacccaggaagcagaggttgcagtgagccaagattgcgccaccgcactccagcttggtcaacaagagtgagactctgtctcaaaaaaaaaaaaaaagaaagaaagaaagtagtggtggcctggtgaagattggattgggtctggagtgatcggaaattgaagtatgagatttcatgaaatttttataactgtactggcctgtaaatgaaagactcaagcttaaagaacgtgttgtaccttcagttcagtttcttccatttaccatatttgcctttttatttgattgactacatccaacttgtttagcaatctacccagctaaccgcgttcactcacgtttaactatatagcattgctctgtatttgtctttcctttcagactgagcagtactggtgaaatactatttgtcctcatatatcaattaggattgtggttggctataacagaaaacctgatagaacagtggcttaaacaaattagctgttatgtgcagaaaacatacaccagacattacagcatccggggttggcatgtggtgccttcatcatgccatctggggctgcaggggctctgtcgttccactcagccatcgttagtttgtgactttcgtgcatgtttcatgacaggtgcaagatgtagcttcactccaacatcatgcctttgttctaggcagaaagaggaagaaaggaggacaaaaggcttatgccaggaagtctgcctcctttccaacagccttttgacccacagcttctactgacatctcattgtcaagagctgtcacatggccacctagatgcaagggagtctgggaattacagtgttaccatgaacaaaaccagtgctcctttagtacagaaaaggagaacaaggcatgttgggtagatgcctgccacactttaaataaaacagccaggcatggtgatacatcccaatagtcccagctacttgggaggctgaggtggaaggaaggatcacttgagcttaggaggtcaaggctgcagtgacccgtgatcgtgccactgcactgcagcctgggtggcagagtaagaccctgcctccaaaaaaacataaaaagtttagaaatgccatatgatgggaggggctgtgctcatttaaaattaccggctggcaacaacatatagtctagcagctttggagctttgatcctggaattaattttgtcagttacttggagccctagcacttctatgctgtctgctcctgtttcctgttctcccccagaatccacgagggcgggaactatttatctttcatctcccacagtgcctggcccagaagccttgctaaatatttgaacaggattgcccagtgagtttgtgcacagttgtgtttgtggacacgtgtcttctgtagctctgggttgggaatgatttgtatccccaaatggctctctcatttggttattttttgatttgcttttagatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggtatgtagggtgtatcctatttggattgcatggaggtggggacgtaattgtctttttattattataagaaattacatgattatattatttgtattttataatctttatatcattacatattatacagtataatctttatattatttcaaggaaataccattatatatacaatgatgattacaataattagaaaatatagaaaagaaaaaaaccactcataattctgtcctccagtgttacccactgttaacctatcaatgtatgtacctccttccagctttttctgagcataaaaatatatatagtgttcgtatagttgaagtctttttcttaacaatgttaatgtctagacaagataaaatttaaaatggtcaaattaggtattcaaagactgttctttgtatactccttaggatttttatttatttttcttctttgatctacttttttgatccttttactgctgtctggtaactcctagaagaataaaagttgaaataaatattgaaatctgcccaaaacttgtgtgtgtgtgtgcatgtgtgtgcatacgtgtgtgcatgtgtgtgtatggggtcagatctaggaaaaccaaaactggtcacacgtgggcttgaccttgtactctatatcaggggtccccaacccccaggccgctgaccggtaccagtccgtggcctattaggaaccgggacgcacagcaggaggtgagcggtgcgagcgagcattactgcttgggctctgcctcctgtcagattagtggtggcactgggttctcactggagcataaaccctatcgtgaactgcacatgtgagggatctaggttgcatgctctttaggagaatctttttttttttttttttgagacagtctcactctgttgcccaggttggagtgcaatggcgcaaccttggctgactgcaacctccacctcccaggttcaagcgattactcctgcctcagccacccaagtagttgggattacaggcacgtgccaccacacctggctaatttttgtatttttagtagagactgggtttcaccatgttggccaggctggtctcgaactcctgacctcaagtgatccacccacctcggcctcccaaagtgctggggtcacaggcgtgagccaccacacctggccactctttatgagaatctaactaatacctgatgatctgaggtggtacaacagcagatctacagtttcatcctgaaaccaaccatgcgccctcccacccatctgccaccccatctgtggagaaattgtcttccacgtggccagacgtggtggctcacacctgtaatcccagcactttgggaggccaaggtgagtggcggatcacaaaatcaggagatcgagaccatcctggctaacgcggtgaaaccctgtctctactaaaaatacaaaaaaattagccgggcgtggtggcgagcacctgtagtcccagcttctcaggaggctgaggcaggagaatggcgtgaaccagggaggcggagcttgcagtgagctgagattgcaccactgccctccatcctgggtgacagagcaagactccgtctcaaaaaaaaaaaaattgtcttccacgaaactggtccctggtgccaaaaaggttgggaaccacatctctatataagtgacatatagatgggagcattatattttcccatcctttctttcccagaaagaaagtgacacagggactttcaagtgctcagatgaccactacaacatgtaggtagatgatatctgggcttagataagctgtacctggctctgttgctgttcagacaggacctgagtttggagcccaagtgctaggtgggagttaggagatgtctaactctactctgcagatctcagctccccaggccaaacacaccaggggaactggggtgagtgaagaatttcagcagcctgaccctccagccctgacagatggctatcaggcacgctgcagatgggcagttcttacagctcgtggccagtaagctgctggtcttttgcaaggtatatttacgacctgtaaatgtcacggctccgtgctggctggggtggataaatgtttctaaggtctttaaaacaggaaataagagcttgcaaattctttggttttacagctctatctcaggaattctctaggtgaatgcagattgcattcgcagacttgctctgaaggtggattgctttttgaggggaaagggagaagcagtagaaccgcattgagtcccacattcttctggatgtttcacttttcagtactcagccctcctggagtctaagaacagcctactttttctttcttttctttttctttttgaaacagtcttgctctgtcacccaggctggagtgcagtgacacgatctcggctcatgacaacctgagcctcccaggttcaagcgattctcctgccacagcctcctgagtagctgagattagaggtgcccgccaccaggcctggctaatttttttgtatttgtagtagagatggggtttcaccatgttggccaggctggtctcgaactcctgacctcaagtgatccgcccacctcagcctcccaaagtacagggattacaggcatgagccaccgtgcccagccgaacagcatatttattgttggggagggcacagtcttcattatttctgttttttctttttctttattgagataaaattcacataacacaaaattcaccatttacccattttaaagtgcacagttaagtggcctttagtatgtttaccatgttgtgtaacccttactatctagttccacacattttcatcactccaaaaggaaacccgtacccattcagcagttcctccccattcctccctccccccagccccggtaaccacgaatctactttccctctctacggactttccatggaaatggaatcataccacatgtggctttttgtgactggtttatttcatttagcataatgttcttaaggttcatccatgttatagtatgtgttagaattaccttcctttttacagctgaataatactctattgtatgggtaagtcacattttcttttcttttcttttctttttcttttttttttttttttttttcgagatggaatctcactctgtcatccaggctgaagtgcagtggcacagtctcggctaactgcaacctccaccttctaggttgaagcgattctcctgcctcagcctcccgagtaactgagactacaggcgcacaccaccacacccggctaatttttgtatttttagtagagacagggtttcaccatgttggccaggctggtcttgaactcctgacctccagtgatctgcctgccttggcctcccaaagtgctgggattatagacatgagccaccgcgccgagccacatttttctttatccattgatcagttgatggacatttagatttttaccttttggctattgtgaatagtgttgctatgagcattcatttgcaagcttttgtttgaacctcagttttcaattctttggggtgcatacttaggaggggcattgctgggacatacggaaacgctatgtttaacttactgaggagccaccaaattgttttcccagcagttgcaccattttacatatccaccaaaagcaatgcgtgagtgttccaatttcctaacatcctcaccaatacttattttcaagtttttttttttttgacactcgctctgttgcccaggctggagtgcagttgtgcaatcttggctcctgcaacctccacctcctgggttcaagcgattctcatccctcagcctcctgagtagctggggttataggcgttagcgaccatgcctggctaattttttatttttactttttaatacagatggggtttcaccatcttggccaggctggtctcgaactcctgacctcaggtgatctgcccgcctcaacctcccaaagtgctgggattacaggtttgagccactgtgcccagcctattttcagttttttaaaaatgataaccatcctagttgtgtgaagtggtctctccctgtgggtttttttttttaattaataattttaaaaaataacttttattgagaccccaccaggtgcaaaacctgttcctggcgttaagctccttcttcctttgcaattcggtctttctcgagtggtcccatgaatgctttcttctcctccatggtctggaagcggccatagccaaacttggaggtggtgtcagtgaacttaaggtcagtcttctccagagcccatcgtctggtctgcaccagcaaagatgtgcagagaatgagcactcgcttcttggttcccaccacacagcctttcagcataacagagttattggtcacttcaccatagtggacaaagccacccagaaggtcgatgctcttgtcagacaggtcatagtccgtggaggcattgttcttgatcggtttgctgtcctcagtaaggtagccctggtcaatcttacagatcttcttgttgatctcagtgtggtgatggtcgcctttctgcccagcacatgccatggagaaggccacatggtcaggatgccatgccccaatccaggccaccttgcacaggcctcggtgggtcttgtggggcagcttcttggtgtgccaacaactggtgacccctttgtagcctttgcccttggtcaccccgatgatgtcgatcatctcgtccagcccaaacgcttggttcacaggtacctgctgctgtagcccctcctgggctcagtccagcttctcagccatggtgcctccgttcacttggatctccatcagctgggccttcttctggcgcagaggaagtaggcgcgtctgggtgtgggcagcgaggcgggtgacttggcagtgcttcctcatgctgctgaagtcttctccagctgcttcttgccatcctcatcctgccatttcttgcagtacttggtaaaggccttcttcctagatttatgccggttgttagagaaacaccttttgcactcatcgttgatgtgctcagcaaagatggccttgaaggtccggaggcctcaaggggtttccacgtagcccgcaatgcccacaaccaccataggtggtgtctccacagtagtcatggcctctaccacctccttcactttcaccttggatcttggcctgtcgacttcccgtgtgatgtgggtcatgccagccttgtatcccaggaaggctgtgacgttgaccagcttggaagggtcatccttagggaagctcttcaccttcccacgttgcctatttcttcactcctatggcaggaagcagagggacccatgtctgggagtggagaactttctgtgagacatcacacaatcaaattccaccggtagagctctccctgtggttttgatttgcatttccctaatgactaataattttgagcaccttttcatatgctttttgggcatttgtgtatctttttggaagaaatttctattctaggcctggcgcggtggctcatgcctgtaatcccagcactctgggaggccgaggccggcagatcatgaggtcaaaagatggagaccaccctggccaacatggtgaaaccccatctctactaaaaatacagaaattagctgggcatggtggcatgcacttgtagtcccagctacccaggaggctgaggcaggagaattgcttgaacccgggaggcagaggttgcagtgagctgagatcgtgccactgcactctagcctgggtgacagagtgagactctgtctaaataaataaataaatatatatatataaaattattatttatttatttataattatccagccgtggtagtgcttgcttgtcctcccagctacttaggaggctgaagtaggaggatcgcttgagcccaggagatcaaggctgcagtgagcatgatcatgccactacgctgcagcacgtagtgctgagtgacagaacaaaaccctgtttcaaaaaaaaaaaaaaagacataactttgttagagttgttacctgaggattcccatcccaagggtctcctcttggatctcatttcttgttccctgctgctgtgattaactgttgagtttaagcagccaccttgaagaatttgcaagatacggttgggacaaaggtgatgctgtcagtccctacctctgctttgcctgaggccgctgacattcatggagagctcactgcgtgctaaggagttgacgtgcattattgtataatacttaaaatgtatcttgagatccgtctcaggttcaaccacttgtgcaaggccactgccagccagtggcagagagagggctcagaccccgaccagcctggttccaaggcccatgctcatgagcagagcctccagccttcttcatgtcagtatctgtatagcttacgtaaggggaaagggctgtgcttctttgctgccagggaccctgtctccatcacccaaatgcagtaggcgcaattattaggcccattttaccgatgaaggctaacctacttgcccagtgtcttatggcaactgagtggttattatggattgaattttggcctccgtgaaagaaaccctggagtcttaacccttagtacctcagtatgtaacttgatttggaaacagcatctttacagagctaatcgagctagaggaggtcattagggggtggccctaatccagtgtgactggtgtcctgatgaaaaaggggaaatgtagacacagacatgcatgagggaaggcaccatgtgaggatgaaggcagagaccagaaagatgcatctacaagccaagaagtgccaaagaatgacagcaaactcctagcagcggggggagaggcacgggacagattgtctatgcagccttcagaagaaagccgctctcttgacaccttgatttcagacttaacatgagagaatacatttctgttgttgaagccacctggtgtgtggcacttcgttatagcagccctagaatgctatgacagtggtaggacaagatctgttaacacctcagtgctggggataaggcattgaacactaagcccctgctctcatggaaagaaatgacgctttcttggcgagagacagacgacagatgactgtgtgatgtcagatgctgaatgctaagaagaaaaataaactggggaagtggggtatggaggaaggaggagggagtgctattttagacagagaggacactgacagcgtgaccttaaagcagaggttggggtgaagtgagcaagctggtgggaagggcaatctggggcatgggcctgtgtccaaggcatgggaaggggacaggagtagccagaggacagagtgaccagagatacagcagggtcaggccactgataggattttgctctggcggggaggggaagccactgagcttcctcccagggaggctgtgagcaagggaacctctgcctcacccattccaagaattccccgggccgtcagcaagcacaagagccagtgtggatgcccgcaccattaggcctgagatcagttcctgccgttactggatgtggagggtttggatggtgctggagggagcacatcttgatcagcatcaggaatacttggttctgtgaaacttgcaacttctgcattcaagggtccctgataggagttggtatgaataaagaattttcttcactgggtgcagtgatgcatgcctgtaatcctagcactttgggaggctgaaggcagaaggatcacttgagcccaggagtttcagaccagcttgggcaacatggcaaaaccttgtctctccaaaactacaaaaattatctggccatggtggtgcacacctgtagtccagctactcagaagcctgaggtgggaggatccctggagcctcagcctggagctcttgcaccactgcactccatcctgggtgacagagtgagaccctggctcaaaaaaaaaaaggaatttttttaaggctttggtgatcgtcacatttcttggacttatgcacagaaattcagtgagtaagagttgagagttgggcggggcgcagtagctcacccctgtaatcccagcactttgggaggctgaggcaggtggataacctgaggtcaggagtttgagtccagcctggccaacatggtgaaaccctgtctctattaaaaataaaaaaaattagccaggcatcgtggcgaatgcctgtagtcccagctacttgggaggctgaggcaggagaatcgcttgaacctgggaggcagaggttgcagtgagccaagattgcaccactgcactccagccttggggacagaggaagactctgtctcaaaaaagagttgagagttgaattagcaaaattctttataatacagatttaaacaatgatataggacacaaaagcttagggtcaacattcttttttttaaggtaggtaactaaatgttataatgcataaaacttagatttggaggagaagactcatccagtcaacccttttttcaactaagaaaactggttcccagaaggtcttggtatgtccagctgtagacagattctaatggtatcattttcaaacttgctcaatgtttcagcatcatttttagaatttttctgtgttagagaatagtttatctttttttttttttttgagatggagtcttgctctgtcgcccaggctggagtgcagcggccccgtcttggctcactgcaagcttcgcctcctgggttcaagcaatcctcctgcctcagcctcccgagtagctgggactacaggcgcccaccaccacacccggctaattttttttgtatttttagtagagacggggtttcaccgtgttagccaggatagtctcgatctcctgacctcatgattcatccgcctcggcctcccaaagtgctgggattacaggcgtgagccgccgcgcccggcccaagaaaaacattttcatcaagtgcccttttgagccctgaacccaggtgctctaccaagcctgatttacagctttgattttggaagtgaaggctaatagaaataaattaactctggatttaaaaatcttatcattaaagctctttaaaaaaaaaaaaaagttataatggtcctaaatgaaccagttttttttgttttttgttttttcgctgcttttatctgatgacacactacggtttcacagagcagccatgaacaggaagggcagcatgaggtctgtggtgtcacacagttcagcttccggagtcttcatcagttagctacaagcacctcctgtttaaagcagagcctcctgatggtgtgtttcagaattagtgctgcagtgtggtgggaagaacacgggttggagcttggagacctagtgaactactccagccctttacagatcggctgcaagaactctttacctaaaaacttggtgagaggccaggcgtggtggctcacgtgtgtagtcccagcactttgggaggccaaggtgggtggattacttgaggtcaggagtttgagaccagccttgctgacatggcgaaaccccgtctctactaaaaatgcaaaaattagccgggcgtgatggcaggcacctgtaatcccagctacttgggagactgaggcaagagaatttctggaacctgggtggcggaggttgcagtgagccgagattgcaccactgcactccagcactccagcctgggtaaccaaaaaccaaaataataaataaattaataaaaacttgggtgagtccaacagaatccttcttctttttttgaggctggagtgcaatggcatgatctcagtttactgcaacctctgcctcctgggctcaggccatcctcctgcctcagcctcccaagtagctgagactacaggcatgtgtgcgctaccatgcctggctaatttttgtattttcttttcatagagacagggtttcactatgttgcccaggcaggtctcaaattcctgagctcgagtgatcctcacaaagtgctggaattataggcgtgagccaccgtgcctggccgggatcctgattttttacccctgcctgaatcaactcctcttccctgttgactagtattagttcacataaatcctcttcagcctggagtctgtgttagtctgctagggctgccataacaaaataccactggcagagtggattaaacaacagattgttttgtttcacagttctggaagccagaagtccaatatcaacgtgtcggcagggttggttcttctgaggcctcgctgcctggcttggagatggtgtcttctccctgggtcctcacaggatcatccctctgggtgtatctgtatccagatttcttcttcttcttcttttttttttttgagatggagtctcactttgttgcccaggctggagtgcagtagcacgatcttggctcactgcaaccttcacctcccagattcaagcgattcttctgcctcagcctccaaagtagctgggattacaggtgcctgccaccacagccagctaatttttgtatttttagtagagatgtggtttcaccatgttggccaggctggtctcgaactcctgaccttaagtgatccgcccgcctcggcctcccaaagtgctgggattacaggcgtgagccaccacgcctggcccagatttcctcttcttacaaggacaccagtcagactgcattagggctcaccctaactgcttcattctactttgattacctatttaaaaatcctgtctccggccgggtatggtggctcatgcttgtaatcccttggcctatgggaggccaagatgggtggatcacttgaggtcaggagttcaagaccagcctggccaacatggtgaaatcctgtttctattgaaaatataaaaacgagctgggtatggtggcgcatgcctgtaatcccagctactcaggaggctgaggcaggagaatcacttgaacccagaaggtggaggatgcaatgaaccaagatggcactgctgttctctagcctgggcaacagagtgagactctgtctcaaaaaaaagaaagaaaagaaaaagaaaaagaacctgtctctaaatacagtcccagtctcaggtggaggtcaggaagggctttgccataggagtttgagagggatacagttcagccatgacagaatgtgatgaggaggtgcaggctgtctctccacctgtcacctgtttacaaagctgatctctggtagaagcccagatggtcttttatcacacaccttgtggaggaacagaggaagtgtgatttctttagtcttgttcttgatccaggagcccagtgaggagcttcgactttggggtgtgtgtgcgtgtgtgtgtgtgtgtgtgtgtgtggtgatacagttaagcacccagaactgctgagtcaggaaagcgttccaggtgatttgtgccccctccaccgcatgccaagagctctgcaccagcttatttatggggcactgcattgtgggggtatcctacatgtctgctgggggtggccctttcagccttcctcccccactggagccttggtgctgctgccacagttgactctgcactccttatccctgctggccagaccctgcatgctcagtgcctagaacaaggctacgagccctgccagcctccttgtgtatgagctgcatctttcagcctgcagggtgcctggtttcatctcagcatctcacttgtagggcatcctctgttagagcgtgacacctaaatttggggctatgattttagccattttctagcaacctttgttctgatgacctctgtggctatgaccgtgagggtggaggtggccaggtaagtgcagggccagggtcatcgtggaatgataagggcctgaattgccttctgagaagacaccaaatggaaaggatgctgttgatgggaattcttgactggcttcacgttaaactagatcctgtacctctgcaggagaggggccagcccagcatccatttgtctctggcagtgtcctgatgctcttggcaccagtatttagaagatgcagatccaactcccgtttttttccctcccctcccctttcttttcttttttgagacagagtctcactctgtcacccaggctggagtgcagtgacccaatcttggctcactacaacctccacctcccaggttcaagtgattctcctgccccaggctcctgagtagctgggatcacaggcatgcgccaccacacctggctaattttttttgtattttttgtagagacagggtttcgccagactggtcttgaactcctgacctcaggtgatccgcctgcctcgacctcccaaagtgctgggattacaggcgtgagccaccgtgcccagtcctaactcccatttctaaggtgtggcaaaggctgctgaatcctttgctgtcgttctgttgtgggtgccatgctggggctctgatgatgttgcagcttcaccccttaccccaggttatctgaaggagctgagggtgttcaagagcactgctaccccaggcttcacagcagcctcagtgagggccactcacactgtaagatcgagatggtctttttgaaaagagcatttctctttgctgaaaagagtctgatatgcttttcgataatttgtagccaggatagtctatttactttgtgtttgagtgaaggaatatttttgccattcttcctttcaggtctgctgtggggctggaggtagtccagatttagagatgaattattcctccagtgctgtgatttgaatggctcttccaaagtccatgctgaaacttaaccccaatttgacaatattggggttgggggggcctttaaaaggtgaccagaccatgagggctctgttctcataaatgagttactcgacgtatggattaatgcattgataggttatcctgggtgaggaactggtagctaaataagaagaggaagagaggcctgagctagcattagcatgctcggcctccttgccatgtgatatcccacaccacttcgggactctgcagagagtctccaccagcaagaaggccctcaccagatgcagccccttgagcttggcctctgtaactgtaaaaagtaaatttattttctttataaatgacccagtttcaggtattctgttataagcaacagaaaatagactaaaatatccagcaatctaacagaattgagtttatagataagggaaagggtttgtgacccacctacactatataaattctcccaagaaagttaggagctagaaactccatgtcacgccttggtgtggaaggtgctgtggactgaattgtgtttctccttctcccctcaaactcatatgctgaagtcttaaccccagtgtagctgtatatcaaggtaggatctttggcagatggtttaggttaaatgaggtcatgaggatgagaccctaatttaataggactgtggccttataagaataggaggagggcaggcacagtggctcacacttgtactctcaggactttgggaggctaaggcaggtggatcacttgagcccaggagtttgagaccagcctggacaacatggggaaaccccatctctacaaaaacaaacgaacaaacaaaattagcctggtgtggtagcatgcacctgtagtctcagctacttgggaggctgaggtgggaggtttgcttgagtccaggagtctcttaagaaaaaaaaaaaaaggaagaggaagagacagacttcctcccacctcccaccatgtgaggacacagtgaggagatggctgtctgcaagccaggaagagagctgaaactgctggcaccttgattgcggactcccaacctacagaactgggagaagtaaatttctgttgtttaagccgcccactctgtggtattttgttatggcagcctgggccaactaatacagaaggaactaagttaaacttgtatttttcagaaaaaaagcaactgtttgaacaggaataccaacattcaagcttgtatttgagtcacatacaggcattcccatttacctatcttttaaaaatagtcttttccttttaaatttctttccaactttattgggcatacaataaactgcaagcatttagaagtgtataatttaaagagttttgacataacgtttatccctgtgaaaccatcaccacaatcaagacaatgagcatggatctgtcacccccagaagtttcctcctgtccttttgtcgtctccctccctcccttgtccccagacaaccactgatctgttttctgtcaccatagatttgtttgcattttctgaaagtttatataaatggaatcccacagtatgtgccgtctctctccttttctggtctggcttctttcactcagcaaagctacttcgagagtcattcaggctgttgtgtacatcaaagtttccttcttttttactgctgagtaagagtccatggatatatacaatttctttatccatttcccattagtggacatttgggttgcttccagtaggtatatgtttaattttttaagaagctgccaaactgtttgccaaagtggttgtatcattttacattcccagctgcagtgtatgaaagctccagttctcccccatcctcttcaacacttggtatggtcagtctttttcactttggtcattttaatgagagtgtaatactctcttattgtggcttttgcattttgtacatgacagatgattagaaaatcagtaagtggtcattgtaactttgttttaattccatagacacataacataaagatcactgtaagaatcttcactgttttattgtaggtaatagcaaaaaattgggagtgaccacccctggtaggggagtagttgtgaagtgagtcatggaacgacaatataatgcacacacagccatggaaccaagtagactggtagttactaacatgaaaaatgcttattataaataagggggaagaaaggacaggcgaacagtttacatatagcccactcaatcttgtgtgtgtgtgagagaaagggagggggtactgtataggagtggacaagatctcgaagccccttattgtaggactagtgtatttccagtttttcacgactctgaataaagctgtaatgaacatctttacgcacgtggctatttttgttaagataaattgctagaggtggagtagctgggtcagtggacgtacagtgaagcctctggacacaggggtatgtgctggcctgcctttgcccctctcctctgcctgcacagatgccagagccacagcctgtcacctgctgtactttgtcatgtgtttatctagcaggaccacattctctatcccaatcttgtcactcttctgattccagaatttctccactattcccatgttgggaacattaggataatttataaagttaaaaaaaaactagagggggttattgatattaaccattataggtaataacaatttagattattctgggaagaagtgacatctttacacacttgggcccttccatatagaaatgtggtagtttccatcattcattaaaatgtactcactttgctggccgcggtggctcatgcctgtaatcccagggctttgggaggctgaggcaggcagatcacctgaggtcaggagttcaagaccagcctggccaacatggtgaaacctcatctttaccaaaaatacaaaaaattagctgggtgtggtggcgcacacctgttagtcctagctacttgggaggctgaggcaggagaatcacttgaacccaggaggcagaggtcacagtgagctgagatcaggcctgggcaatagacggcgctccagcctgggcaagagtgaaactcggtctcaaaaaaagaaaaaaaattgtggctgggcacagtggctcatgcctgtaatcccagcatactgggaggccgaggcggggggatcacctgaggtcaggagttcgagaccagcctggccaacatggcaaaaccccatctctactaaaaatacaaaaaatagctgggcatagtggcgtgcacctgtaatcccagctacttgagagactgaggcatgagaatcgcttgaacccatgaggcggaggttgcaatgagccgagattatgccactgcattccagcctgggttgtcagacagagtgagactgtgtctcaaaaaaaaaaaaaagtattcacttatgtccttaagagttcttcttaaataagaccttcctgttcctcaagtatattaagtattttatacatgtgtttttgctattgtgaatgggattattttcctcaggtagacaggtataccgtcaaccaatactgatttgtatttttttctaatattttgctagcatttcctggaacagtgttgaatagcaatgttgctatcagtgtgttaaccacggtaatgttggctgctataacaaagaagtccaaaatcaatgtcctcgatgtaattgaagtttatcctcactcatgtatcagttaagcatgttattcagatgggtgggcagctctcttctacacggtcattccagaaactcaagctaggactctgtcttcttttttttttttttgagacagtgtcttgctctgtcagtcaggctagagtgcagtggcacgatcttggctcactgcaacctccgtctcccaggctcaagcaattctcctgcctcagcctcccgagtagctgggattacaggcgtgtgccaccacgcccggctaatttttgtatttttagtagagacggggtttcaccatgttgaccaggctggtcatgaactcctgacctcatgtgatccacccccctcagcctcccaaagtgctgggattacaggcatgagccaccacgcccggcccaggactcttgtcttcttgaacacgtggctttcacagttcctcttttcattgccattctgtcccacaggaaaagggaaggacacagagaagcacacatactgaggttttaaccagccaggtcctgatggcacgtgttatgtccacccatgcctcccagggagactgggcagccatggcccagctgcagccctaactgaagaagaagggagccgtgatttgggtgggctgggcccagtgcctgcactcaccttccatttaatggaagggtctgtagtgtttcaccatcatctctaccctgtgacctccctctgtttcttgtgtcataaaggatcagtttattccttggttactaactttaataactacttatctttatatggcaagaaaggcatgtcatttcattacctgatcaacatgtaaagtattgaattgctttttaccaagcatcacagttctgccttatatattactcttgtgtttgggggtcattcttgtacttaggctagattttcccaatgcctaggatgtgcctgggaagcaaatatgttggaggataatctaattccgatttgtggaatgcaggaaggagcccggaattggagcacctggggtcatgttcagactcaccatttctgagattggggcagatgcactggttacccaccgataaccattctgccctcttctttcttgccaatagagaaccccagttatatttggggatcaggtggtgatgcgctgcagggtgggggccccagcagtaaatgttattgttctaggacttcatcctaaaaatcctgctttccttggcagggattaatttcgaggtgggcacatgacctgctctagcccaatgagatatggcgggaaggctgcagggtggcttctggaaaggtttttttctcatacaaagagacaaaaaggaacacacactgccacgacagggaaagataggttaagagtcaattcactggcagggcgtgctggttcacatctataatcccagcacttggctgaggcgggaggacagcttgaggccaggagtttgagaccagcctgagcaacatagccagaccccatctctacaaaaaaagttaaagttagccaggtgtgacggtgtgtacctgtggtcccagctagttgggaggttgaggcaggagaattgcttgagcccacaaggttgaggccacagtgagccatgtttgcacaactgtcctctagcctgggcaacagagcaagaccttgtctaaaaaagaagagtcaattcatcattgacagcatgtaaggcaccagaatgcttggatcttttggggatgtcactgagcccttgcaggaaccaaatgcagaaatgagctcctttagccctggtttcccagccttggcatgctgtggcatggcagacattctggctgcgggtgggtggtggtctgtgcactgtaggatgttttcttttgtttaagaggcagggtctcactatgttgcccaggccagagtgcaggagctgtttacagatgcagtcatagctcactacagcctcacacaatcctctcgccttcgcctcctgagtagctgggatcacaggtgcgcgccactgtgcccagctctctgtaggatgcttattcccatcctggcctccctgacttctgtccagtagatgccagtatcaccccctcctccacccaaagttgtaacagccagaaatgtttccacacattgccaaatgtcccctgggggcaaaatttccccagttgagaaccactgctgtagacctttggttttgtgaggcaatacattgcttcatttaaacctgtatggcttgatggtctgttctttacagccacacatgtcctagctgagctcacaaccctggaccatcctcaacccgagagccagagcctgtttcttctgcaggctgacgtggacgtacttgtctgttgacagtaaaggtattttgtgcatccttaaaagatgcagtgtcttgcagctgttggagtggtttctggctgggagcaggacgcctacagagcagttgcagaggaccttctgtctccccatggcggaggcaccattccaactacggaacctttgttgtgttttggagggggtcgtgtgcttccagcacctgccgcctctgccagccacagcactctgcctctttgttctgagtgcccgggacagagttgtatagctgctgccttttggagagaggagtcagctttgggcttgaatgtatctggagatagcccagctttcatgccatcttcacatttcctgtgtacatggtttcttttttttttttttttagatggcgtctcactctgtcgcccaggctggagtgcagtggtgcagtctcaactcactgcaacctctgcctcccaggttcaagctattctcctgcctcagcttcccgagtagctgggactacaggtgcgtgccaccacgcctggttaatttttgttttttgctttttctattttatctttttttgagacagagtcatactctgtcgtccaggctggagtgcagtggcgtgatcttggctcactgcaacctccggctcccaggttcaagtgattctcctgcctcagcctcccaagtagctgggattacagatgtgcaccaccacacctggctaatttttgtatttttattagagatgggatttcaccatgttggtcaggctggtctcaaactcccgacctcaggtgatccacctgccttggtctcccagagtgctgcgattacaggtgtgagccaccacgcccggcctaatttttgtatttttagtagaggcgggtttcgctatgttgcccaggctggtcttgaactcctgacctcaagtgatccacccacctcggcctcccagagtgctgggatcataggcatgagccaccgtgcccagcccctgtatacactgttgcggccccttcccacccagctgccgagagatggttctttcacaggtctcctgcttccgtgcaggtagcttattccagggacagggaagcaggaggaaaaagcactaggaggaagaccgcagactggattcagaacaggctatcgtggagagctgtgtgcttcgctgccggcctgaggctctgcgttcccctccttggtgctcaggctgcccggcatacgcagcaagtgctgacccagcaggcagcccacgtgcgcttcaggtgtgggaggctctgcgggctgcggggaacaggatcgctgtgggaggttgagcctggagctctgaacagccactctgcgcccaatctgctgtagcgctgagggtcaggaaggcctctgggagttctctagaagaaggcgctggggaggaggagttaacatctcatttcattagagcatgccagttctgttctgggtgtgacttttgaagaatattgagttctaccagtagaactttggggactgaaacctgttgaggatttgtagtaagactgtgtcccgaaggcgttcttccttttcttctgtctctgactttaacaagcaggtttccctataagctttggtgtttgttaaacagatcatttgtatgtgcaataaaatatgtttaaaaattagaaaaataacatctcccgatactatgttattttatatttttaatggtatgattacttttatttgattttctggtttgtgatgataaatgcataagaatggcagtgttctctgcatcatgtacatttcaaggtgtagactgtgttctgaagggagagtcggccccacatccttaccttcttttcctgtggtttattgcagaactcagctgccttcacctcctcctgccatttttcatcacttctgagactgttagctcttagaccccccaaatagaacagtttcctttgtgagcccctattatatgcttgccaccattgtttttcaaacctaggatcctccaaactcagtgccactcagcctcttctactgatgaagaaactggagttcaaaggcttgcttgcagcttcccaggtgtatgacgagtatttcaggtcggccagcgccttgtgaagcccacactccagggttgagggcaacatgtaacaatgtcagggaaggctgaggaagtgctgtgccatcgcaaaagaataaaatataagtctagaaatgcggaaggtactgtacagcatcacagctacctaaacttcctctatgggaagacagggaaagtaggcgttagtggcaagacagagtggctttgagtctaagtgtcataataaactctgacggggaaaaataaggggcagcatttgcacatgtgtgctgcagattacccgctgtgaggcagcggtgagtttgttgccttgtgttttaaaaagtaattttctgggccgggcgtggtggctcacacctgtaatcccagcactttgggtggccaaggcaggtggatcacttgaggtcaggagtttgagaccagcctggccaacgtggtgaaaccttgtttctactaaaaatacaaaaattagctgggcgtggtggcgggcgcctgtaatcccagctacttgggaggctgaggcatgagaatttcttgaacccaggaggcagaggttgcagtgagctaagattgcgccactgcactccagcctgggcaacagaacgagacttcgtctcacaaaaaaaaaaagaagtaattttctgatctagcatgtggattcttgagtcatcttaactaagagattgggagcagcctgtgtggctgacaggccctattgctcatgacttgtgtatgtgtacacgtgtgggatgtgtgtatgcatgtgtgtatatgtatgcagtgtgtatgtgtggagtgtgtgcatgtgtgtacatgtatgcatgtgtagagggtgtgtgtgtgtatatgtatgggaagtatgtatgtatgtatttgtgtgcctgcatgtgtggacatgtgtacgcatatccagtgttaaccctgacacactggggaagtggaaatagaatgaataccctgtatgtttcagctcctttttgagtttatcctgcacgaccagcttatgagtaggtgatggtatatttttggtcacctacagcacttcctcagcctcccctgacatgtctacatgttccacccccacccccggagtgtgggctttgcagggcgctggcggacctgaaatactctgcacacctgggaagctgcaggcagacctctgagctccagctcgttcttcagtaaaaggggctgaatggtgctgactttggaggattccaggtttcagaaataatgggtgagaaagcagagcctcagagctatcaggtgacttgtgacaggcttgctcagatgagagctggagcccggactcggacccaggcctgccactcagagcctggcctctgtcacagttcccctcccattgactttcggggcccgtcttaggagctcgaccggcggccagcaaaacattccctccacagcagagccacctctgggtaaactgataaaaatgagcttctgaacctgccaaggtgccagggctcaggccttggcttcagcaatgtcattcccccagcagacggtgagtgggtgccagccacagtcaagcacccactgtgctcttcccccaaggcctggcctgggttagctggctgtcctgcccctcccctcccctcccttcccctcctctcccctcccttcccgggggagggtgcttgactgtggccagcgcccattcatcgtctgtggggagaatgacattgctgaagccaaggcctggctttcgacaagagttttgctctgttgcccaggctggagtgcagtggcaccatctcagctcactgcaacctccgcctcccaggttcaagtgattctcctgcctgagcctcctgagtagctaggattacaggagaccactaccacatctggctaatttttgtttttttttagtagagatggggtttcactatgttggctaggctggtcttgaactcccaacctcaggtgatccgccttcctttgcctcccaaagtgctgggattataggcataagccactgtgcccagcctatttattttattttttattttatttttgagacagggtctcactttgttgcccaggctggagtgcagaggtgcgatcgtagctcgcccacagccttgacctcctagttccaagtgatcctcctgcctcagcctcccaagtagctgggactacaggtgcacatcacatgcccagctaatttttgtattttttatagagacagggttttgccatgttgctggtcttgaactcctgggctgaagcaattcacctgcctcggcctcccaaagtgctgggattacaggtgtaagccactgcgcctggcctgcttcttttttttctgagcatgcttttaaaatctctagtaggtgatacacccagccttcagttctactcctactcaagcagcatggtaattttaagaaaattttaaaaggaaaaaaaaagcatattctaatgtgtcttcttacctgatgcagaagatggagttagcctgagtgacccattccttgctagcagctttattggaagctgggatttgggtatgtggataactcatgctgagagctgattaatcacgtgcatggccctgttagggttcaactgacttaggtaaatacaacacaatgatatttcagctgtgacctttcagagaaggaagctccttgtttacataggagttatagcagcactgctctcccagttcaacaaaaactggtctcactggttacctgtggaaccccgactccctgagatggctctcggcagccttgccttctgcctgtttctccagcttatctcttgccaccgccactccctcaagctggcaaagcaaccgggtcatgccatttcagtcaaggtggaatgccacaccatgagcacttgggaagtcctggccaagtgctggtctgttccattttcgtcctgtctaaagggcactaacagtgccccctggcaggtgcttcactgagcgtttgagcctgtgtcacctggcctccctgactcactgtgccactgtgcagcttcctttcagtggcatgaaaagaacacccttacaaagatgcctgacttccagaaggaagacatgtcagtgtttcaccgtgaaaaatgcaactcctcgtttgcttggtgggagacgtgcttttaaattggctgacttacatttctttctagacaaagacatctggcattctgaagtcagcattgtactctgtgcaaaagtagggtgactgtctcttctaggaacttttaaaggaaacatttaacatttttattttacgggctaaataaagcgttttaaaaatgaaacataattctgtccactccccacccatatggttaaattactccttttttaaagcattttaaattgtggtaaaatacatataaacaaattgtggtaaaatacatataacataaaatttaccatcttaaccatttttaagcatattaacttgtgtccatgtgtagccttttggaatttttcatcgtgttccctacacagaatgcttctaaatcatgccgtgtcctggggactgtcatactgtcaggttgtgtaaagtcaaaggaaacaaagatattttcttgggtggagcaacagtgacacttcctgatttctattaagcttggatgtagtttgaatctttttttttcaaacatactttatacttaacattttagtattttcttttaaggtcagcctactgagcctatgcatataatgaggtcaaaaatgttacaattatgtcctaattatagctcaaggaatgcttttagaacagtgtagttcctgagtgaaataaataagaaagtttaatttcctgtttaatcagtttctcctttttaaatttttttagcactttaaaaagtgattttgaaggctgggtgcagtggcttacacctgtaatcccagcactttgggaggccaagacggtggatcacaaggtcaggagttcgagaccggcctggccaatatggtgaaaccccgtagctgggcgtgctggtgcacgcctgtagtcccagctactctggaggctgaggcagcagaatcgctagaacccgggaggtggaggttgcagtgagctgagatcacaccactacactccagcctgggtgacagagcgagactctgtctcaaaaaaaaatgggattttgggttaggcacagtggctcacgcctgtaatcccagcactttgggaggctgagacaggtggatcacgaggtcaggagtttgagaccagcctgaccagtatggtgaaaccctgtctctactaaaaaatacaaaagttagctgggcgtggtggcatgcacctgtagtcccagctacctgggagactgaggcaggagaatcgctggaacctgggaagtggaggttgcagtgagccaagatcacactactgcactccaacctgggtgacagagcgatactccgtctcaaaaaaaaaaaaaaaaaatgattttcagctgggcacagtggcttacacctgtaatcccagcactttgggaggctgaggcaggcagattgcctgaggtcaggaattcgagaccagcctggccaaaatggtgaaaccccgtctctaataaaaatacaaaaaataaaaattagccaggcatggtggcacatgcctgtaatctcagccactcaggaggctgaggcaggagaatcacttgaacccaggaggcggaggttgcagtgagccgagattgcaccactgcactccagtgttgggggacagagtgagactctgtctctaaataaataaattaattaaattaaaagtgattttgaaaacatggccatttttcctggccagttcatctctttcttttttttttcttttcgagatggagtctcgctctctcactcaggctggagtgcagtggcgcaatctcagctcactgcaacctctgcctcccgggttcaagtgatcctcccacctcagtctcccaagtatctgggattacaggcctgtgctactacgcctggctaatttttgtatttttagtagggacagggtttcgccatgttgcccaggctgatatcaaactcctgacctcaagcgatctacctgcctcggcctcctaaagtgtgggattacaggcgtgagccattgtgccccacctcagttcatctatttctctgtgatatttattctatagttgcagaagaatatttctcatatgatacgtatattaagcttactggccagccagtttgggtttctggatagtgaaactgtcctggaagtgtttgctgagcttttcttgctggagaagattcttggcaaagcctggatggaggatggagatgagaaaggtagtgtgagggtggcacacctgttttgtgctaattccagtcttggcagccctggacctgccgggagagggatgacagtgacatgtggcccagtttttgctcagagaaggaaaagtcaccaagaccgaccatgagggcaggagctcttgcttctcctcctagatgagagttagaaggaatttgagagcaaggcttctttcttgggatccaaatacttcttaccttggagttttcctagccgtggctagtgggtcataatgtcagcgacattgccaaatgggagcggaagagtgtcgttgggggaagggtgaagacgctgtcagagaataagacataccccactagaactttaaaaaacaagtcagaaaaaaaaaaaaacaaaaaacagaaaaaaacccacatacccacacatacaccctgaagagggaatcaggagtttgcaagccctagaaggtagttattgtggtaattaaagattgaaagctcactctcaagagagctgcaccaaatccctgggctgcctcagggtttgctgaaatgagtcccactcttctctggtcagttcagtccaggaggggctggcgtgcaagtgtcactcaagaattcatggctaggctgggcgaggtggctcacgcctgtaatcccaacactttgggaggccaaggcaggtgaatcacttgaggtcaggagttcgagaccaatctggccaacatagtgaaacctcgtctctactaaaaatacaaaaattagccgggcatggtggcacgtgcctgtaatcctggctacttgggaggcggaggcaggagaattgcttgaacccggaaggcggaggttgcagtgagccgagatcacaccactgcactccagcctggcaacagagtaagactctgtctcaaaaaaaaaaaaaaagtttatggctcttacagccttagccagcaagagcaattgccatgaaacagcattatttcttttctctttatgctattgtggtaaaatacacatggcctaaagttgaccattctaaccatttttaagggcacagttcagtggtattaagtacattcatattgtgtatcctgccatccatctccagaaccttttcatcctcccaaacagaaacttccagatggagtcctaccgaattgcccaggctagtctcaaactccttaggataactttcattcttggctgggcatggtggctcatgcctataatctcagcactttgagaggctgaggtgggtggattgcttaagctcaggagtttgagactagcctgggcaacatggcgaaaccccatctctacaaaaaatatagaaatcagccaggcgtggtggtatacgcctgtagttccagctactcgagaagctgaggagggagaattgcctgggcttgggagattgaggctgcagtgagccaagatcacaccactgcactccactgtgggtgacagggcaagacactgtcaaaaaaaaaaaactaccaaaaactaattttcattctttttttttttttttgagacaagagtcgcccaggctggagtacagtggcatgatcacagctcactgcagcctcaacctcctgggctctggtgatcctcccacctcagcctcccaggtagctaggaccatagccatgtgccaccacacccagctaatttctttgtatttttttagtagaggccggtttttgccatgttgcccaggctggtctccaattcctaggctcaagtgatctgtccttcttggcctctcagagtgctgggattacaggtgtgagccactatgcccagccactttcattcttttttttttttgaaatggagtctcactctgttgcccaggctggagtgcagtggcacgatctcggctcactgcaagctccacctcctgggttcacaccattctcctgcctcagcctcccgagtagctgggactacaggcgcccgccaccacgcccggctaattttttgtatttttttagtggagatggggtttcactgtgttagccaggatggtcttgatctcctgacctctgatctgcccaccttggcctcccaaagtgctgggattacaggcatgagccaccatgcccggccccactttcattctttagaacaaggaaattcatactgttttatctaagaaagaagctttcctaagtcctgtacttggacgagggcaccggtgttgtctttgggtacagggcattagcaattgtaaagaacagtgttgaaggggtgaataagtaatatcttttcctcatccattgcgaggttcatggctgagacccctataacgaaagagagattaacgagagaaaagcatgcaaattaagttttacatggcatgagagccttcagaaatgaagacttggagaaacagggattccaatctgtgtctctgtgcttgggtttgatgaagtgtgacagtcgcgtagaatgactggatgcgggctgtgatgattcaggaataccccggggggaatttagcaaggcctgtttgttcaggttcttcttggtgcctctgggagacattccttccctctgggtatagggcaggacgcctgtcacagggcgttcaggggagaagggagggagatcttgatctccctaggctttatgagctgcctaggctttatgagctgccacagggaggaaggtgagagtatccttcctgcttctgctgttttctcagtttcccaggtaccatattttggggtagcatttcctgcaccccattagtatccaccagagaagtttgccctaaaaatgtgctgtccctcttgtgtctggtgctggccttcagtgagactgaagggcatcacggaaaagtctcgtaaggtggaattgcggggagcccgagtgggaacctccatggtggcctttaccactgatccaagcaactggttctcccttctccactgggctacagctctgagcttctgcacaaagagtggagtctccatctttaaatattctgcttatttttcaatttgtcattatactaagaggtcatgtgtgtggattacttactttgtgctgggcagtatgctaaattctttatacatggtaactctttatgcttgtaacttcgtgaggtatcacagtcctcatttttacagatgaaacttcagcccagaaaggtaatttgcccgaacagcaaattctgaaactggaattggtggctctggtgcccaagcttgcatatttagaccaggcatcagtaatagcctcagttttgtttattgctttgttaagccttagttttgaagcacttgttaagtgcgaggctccatgtagagtgtataaacactcaatctctgtgtgacgacagctccaaggagcagtccagcaagttctgtctggccaaatctagacctggttttgattaactttgttcatgatctctagatcactctgctctatgcttgaacctgtatgcttgagtcaagcttacctctctgatgggtgaagaaaatgatatttcactgttatattaattttatttttcttaccacaaaggaaggatatctcttcatttttctaagtcctgttggttcattgcctttgcttttgctgcatttctctctctctctctttttttttttttttttgagacagagtctcactctgtcactcaggctggagttcagtggcacaatctcgactctctccaacctccacctcccaggttccagtgattctcctgcctcagcctcctgagtagctgggactgcaggcgtgtgccaccacgcctggctaatttttgtatttttagtagagacagggtttcatcatgttggccaggctggtctcaaactcctgacctcaggcgatctgcccatcttggcctcccaaagtgctgagattacaggcgtgagccactgcacccagccttcttgctgcatttttaaagaagacaactgcagcttgtctctcttgataagcagtctgagtttgcctttagtgcaccttttcttcaacagaaatcagttgcctgtctcagatgggccttgctcacattattcacatgggctgggtacagtggctgacacctgtaatcccagcactttgggaggccagtgcaggtggatcaattgagcccaggggttcgaggccagcctgagcaacatggcaaaatcccatctctacgaaaaaataccaaagatgctgggcatgatggctcatgcctgtaatcccagcactttgggaggccaaggcaggtagatcacttgtggccaggagttcaagaccatcctggccaatgtggctcaacttgtctctactaaaaaatacaaaaattagccaggtgtggtggcacatgcctgtaatcccagctacttgggaggctgaggtgggagaatcacttgaacctgggaggtggaggttgcagtgagctgagattgcaccactgcactccagccttggtgacagaacaagactctggctcaaaaaaaaaaaaaaaaaaaaaatccccccaaaacaaaaaaaaaatcagcagggtgtggtggtgcacgcctataaccctggctactcaggagactgaggtgggaggattgcttaagcctgggagttagaggttgcagtgagttgcaatcacaccactgcattccagtctgggtgacagagtgagaccctgtctcaaaaaatcaaaacatgataaacatggtcaacatacagtgaacaagttcattccacttttactggttacagcctcagttctgggctatgtgtctttttctatgtctttttcacattaaatgaagtgaggtaacacatgtaaatgagaaaaaatagcaatcagttctattaatttgaaatgagtggttgtggttccttgcaattgcgttcatatgaaaagagatctatcagtcaggatagggaaagttatgcacagtaacaaacaatcctcaaatcatggtgacttttacaacatggtttatttctgccttactggatcagaaagtagtttctgctttctgaaatttctcaggggctttatctcaacctgtgtttccataatcttagaggcagggaaaagagaagtgataagctatgagttggctttgaagatctgtgccagaagtgactcccataattctattcatcttgttggccccaagtatgtcacgttgccgtgcctatactcaaaagagcagaagaaagggatcctgctgtgtgcacagactgagggaacctcttaggaatcccagatgctccccatgggaagtacttaacatcttttttgtcccaaatagcagaagtcttagagtataatgagcaaaaatgagatttggtagtgttaaaaagagaaaactctgccttgacaaaaataatggtacaggtcaagacagcttttagctctcctgctcttgaatccatggagaaagcttgttagcctgtgatcagtaagccatgggagtcgtggaaatgttttctgcgggctggctgggcattgctggtggtgaagctggatgttggctgcctgaccgttctatgtgtttgaaattgcccatgagcaaatgtactgtttgctatccattatccacgttcattccttctctgctgctaccgtcagtctgttttcatcctttgtgacagtgtggaagttaagtggcctctcctctgttctttttttttttttcctttttggaacataagcacattttttcacattattttattagcattccctttgttttaaggtatcacattcttcataaatgatgttttaagggctaggcgcagtggctcacacccataatcccagcattttgggaggctgaggcaggaggattgcgtgagcccaggagtctgagaccagttgatcattctgagcaatgtagggagaccttgtctctacagaacaatctttttaaattagccaggcttggtggcatgcacctgcagtcccagctattcaggaggccaaggtgggaggatcactggaacctggaggttgaagctgcatggaaccatgatcgcacacttgctctccagcctgtgtaacagagtgcaacccttttttgatgaccactagttatatctgatttttttttttttttgagatgagatggagtctcaccctgtcgcccaggctagagtgcagttggctcactgcaacctctgcctcctgggttcaagtgattctcctgccttagcctcctgagtagctgggattataggcacgcgccaccatgcccggctaattttttgtgtctttagtagagacagggtttcatcatgttggccaggttggtcttgaactcctgaccttgtgatccacccacctctgcctcccaaagtgccaggattataggtgtgagccactgcacctggccatatctgattttttttaaagatgtcattttattgaatttgagaattcacttagaccacagatatctgatgaaaaatattcttgttttccttgtcttcctttcatgtcctgcataacctgagtgtgctttagaggtgggatcgtagtgtttgcgtacaagaggaaagttgtcatggccctgtggtcatgaggctgagggcccacgattctgatgtggatggaatgcagctggcattgcacatgtcttagatgctcttcccaactgcccgctttgttctaggcactgtgcagggtgctggagacagcagagaagagtgagatagtccctgccctcgcactgtagagggaaggcctgttctgcctccctgagatgggggcactgagctaaatcacacgtgaggaagagttagcaaggtggccggaagggcatttaggcaaggggcagtgaaaggaaggctggagccgtgcttgggagaccttttaagaaacgtgaacttggccagatgcagtggctcacggctgtaatcccaacaatttgggaggccgaggcgggtggatcccttgaggtcaggagttcgagaccagtctggccaacatggtgaaaccccatctctactaaaaatacaaaaaattagctggatgtggtggcgtgtgcctgtaatcccagctactcaggaggctgaggaaggagaatcgcttgaacccaggaggtacaggaggtggaggttgcagtgagccaagatcatgccattgcactccggcctgggcaacagagcaagactccgtctcaaaaaaaaaaaaaaaagaagcgtgaacttttaccctgtaggccttcagtaaatatttgtgtgagcaaatgaactacttatgcagatcattccctgataacatcagacactgtgttataagattaagccggccaggcgcagtggatcacatctgtaattttagcactttgggaggccgaggcgggtggatcacaaggtcaggagattgagaccatcctggctaacgcggtgaaaccctttctctactaaaaatacaaaaaattagtcaggcatggtggcgggcacctgtagtcccagctacttgggaggctgaggcaggagaatcgcttgaacctgggaggcagaggttgcagtgagctgagattgcgccactgcattccagcctgggtgacagagcaagactgcatctcacaaaaaaaaaaaagaaaaaaaaagattaagccatgaggggcctcccacgcacaaagttctgcccatggttactctgtgccacgaaggacagcatcgatctgttcacactctcgaccttgcttctcgggtacagcaagcactctgggatgctttcccgcagacgtgtcgtgtatcctgcttatggaagcctagcttgggactaccattgctccagcccagtggggtggtgctgttttcctcctggagaacacgggttcctcccagcaccatctccaactggtagaaatgtcaggcgtcacagcctggaaggctttaatcccaatccatatcttctgagtgagcccctactcatggcttcctgagatggagaagcacacggccctcacccatcacgggctcagaggtgtgaccgagaagctggccacctactaagaaagtccttgtgcctgcctcatctccagcgctgccagagctgctgtggactctcgccatgcagtccctctgcccctttgttgtgtatgtctctttcttacagccacactgggacatggctgcagtctctctggcttcagcagatccactctccattgtaaatatcgctgccttcttcctcatgtgttttttttgtcttgtttgacaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacaggtgcgattgcttctctgctgtgttcctttttattacccaagtaaccggtatttcagctcacaagatgagaaaatgacaaacaggcaaaataagcgtagggctgtgtgtgcaacagtttatcataaagccatcaccaggagacgtcactgggcgccttctggagtctatccgtcctaactttgctttctttctttttttttttaaatttaagttctagggtacatatgcacaacgtgcaggtttgtcacacatgtatacatgtgccatgttggtgtgctgcacccattaactcgtcatttacattaggtgtatctcctagtgctatccctccccactcccccgaccccatgacaggccccagtgtgtgatgttccccttcctgtgtccaagtgttctcattgttcaatccccacctatgagtgagaacatgccatgtttggttttttgtccttgcgatagtttgctgagaatgatggtttccagcttcatccatgtccctacaaaggacatgaactcatccttttttatggctacatagtattccatggtgtatatgtgccacattttcttaatccagtctatcatcgatggacatttgggttggttccaagtctttgctattgtgactagtgttgcaataaatatacgtgtggatgtgtctttatagcagtttgatttataatcctttgggtatatacccagtaacgggatggctgggtcaaatggtatttctagttctagatccttgaggaatcgccacactgacttccacaatggttgaactagttaacagtcccaccaacagtgtgaaagtgttcctatttctccacatcctctccagcaccccattttgactttgctataagggaactttagcatctgaacgtgcggacagcttcattgctggcttgttacgtaacagtgttttgtgaccatctcatgtcatacccacacatcgaaaccagcagtttaaatggccagctgtttgcttgtgaaaactcccctcggctggcttgtcacctgggacttctgactgggtatcttatttctgccccgctccctctcgttctttctcgaagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacaggtgcgtgggcgtcttgtccaggctgtgtttactccactgctttataagacgcggggagggggccgggcgcagtggctcacgcctgtaatcccagcactttggaaggccaaggtgggtggatcacaaggtcaggagatggagaccatcctggctaacacgatgaaaccctgcctctactaaaaataaaaaaatttagccgggcatggtggcgggcgtctgtagtcccagctactcgggaggctgaggcaggagaatggcgtgaacctgggaggcggagcttgcagtgagccgagatcgcaccactgcactccagcctggacaacagagactctgtctcgaaaaaaaaaaaaaagacacggggaaggaagtgcagagacatgggaagcagcagtaggtgtggaggtcgggttgctctttcacatttccttggtggttgtgatttcaaattcctcccgggaatctctcttgtctctttaccaaaggggaagtcccgagcccggagagatgagatcctttaggcggagagaaatgtagctcattaataagggagaccatagtgcagggttcccatgatgtcctgtcccgttacggagttacccacagagtcaccatgtgtggagggaagacataccctcttagggcgcctagtgtggaggaaatgaagggaccctttcctgggcacttgcagcgtgcattacacacatgatcacattgtgtaatgaattcctctgctccaggagttacctccatttacaggtgagggtcagagggtaagaaggtttcccagtcgcacagtcagtgagccccacagctgggattctattccactgtatctattggattcttttttttttttttttttttgagacagagtcttgttctatcacccaggctggagtgcagtggtgcgatctcggctcactacaacctccgcctcctgggttcaagtgattctcccgccgcagcctcccaagtagccaagattacaggctcgtgccaccacacccagctaatttttgtatttttagtagagatggggtttccctctggcggccaggctggtctcaaactcctggcctcaagtgatccgcccacctcagcctcccaaagtgctgggattacaggcgtgagccaccacacacggctcatatcagattctaaagtccttcttctttccattaaactaggctgcttctaaattaaaaagcaaagccagggcagggcttgagaaggcaatttagtgtgatgtgaagcagaatatcttgacaggtttcagtagcaccttggagaaatctatagcactcatatgcacaaaagttcatgtagctttgtgtgtgtgtgtgtgtgtggtcactgcttaggaatgggagaaagtgtgaatctgttccgactattgagtatggccgggcacggtggctcacacctgtaatcccagcactttgggaggccagagcaggtggatcacttgaggtcaggagttcaagaccagcctggccaacatggtgaaaccccatatctactaaaaatacaaaaaaattagccggacatggtggtgtgcgcctgtaatcccagctacttgggaggctgaggcaggggaatagcttgagcctgcgaggtgaaggttgcagcgagccgagattgcaccactgcactccagcctgggtgacagagtaagactacgtctcagaaaaaaacaaacaaacaaacaaaaaccagactgttgagtatacacagtgacctttgtttccggagaagtataaagtaagaactcacttccagcttattaactcttctgagagatgccacagtgattcacctctgttaatgggacctgttttaagagcccatgttcagtcactggtgacttttgtgcttgtaaaagctgccatgtgattacacaacgcgctgctcatattaccctgtgctggaggccctagtcaggtcaccctttcctgtggtgtcagctgtgactgaggggtgcaggaggctggagtctaacccaggaatcaatccaaggtccatttgcacggctcccccagccttaagtaaaccaagtaatcagaatggtttgaagggttagttaggaagtggccaagggtgcatttcgtgagctctatatcaggacttgacagatgtaactaaaacattgcactttaaccatttcaagctctcacatagaccaggtgttggctctccatttcccaaaggagaatccacctttacagtttctaccttaggaggcagaatctgtctcgttgcggttttaagcccagcgccaggccctgtggctggtacacggtgagactcggtaagtgtgtgttgagttaacgagtggtccaggtcacataggaggcagctggaggacattgccagactccatgccaatggactcctaatcccaggccctttctagaagttctgctgtgtttgtgttctgatgacagatatgtgagtatacatcctacatgatttttccatcattggacagatgaacacattagttccctaaagcttactgtgatcttttaaatctgtgtgaatcacactagaagtgtaaatagttggagtgtttttgttttcttagttgataaataaaggttcatttgaacagttgctaaagttgcttaacattgattttttttctgaatattgtgatttcttgacattgaaccaagagccaagtaaagcttcatgaatcaccgaatctatttagctgtgacagaaaaccaaatgcagtgtggcacccagaagtgattagttatcagctctccaaggtggatgcaggtgaaaggttatacaataatctctgagccagtgtgttgcagccacagtaattgaagtgactgtacaagattttttggttgctatatccatttcagtctgagacggtttggtaactgttcccagaagtgcttgggtagccaggtgtggtgacaggcacctgtaatcccagctatttggaagactgaggcagaagaatcacttgaacctcggaggtggaggttgcagtgagccaagatcgcaccactgcactctagcctgggcaacagagcaagactccatctcaaaaaagaaaaaaagtgcttgggaattgagtgaaacaccccaacaaatgtgcagagagcagaaagggagggtgcagtggggggggtcatgatgagcacgtgggtagaaattgcaaagtggtgagttaggttgagctggtgaaggctgggatgactcacaggtttcatgtaggtggaggctgtccctggtgtgtgctttttagtgaaccataaggaatgaaacttttggcccctgttagaacttattatccaccctggctttctaaccctttggggtctgcagataacctatgactggtcagaaatcctttttttttttttttaagtgcccatgaaatagctacatagctgtgttttgctgtactaagaaaacaagattagaacagggaaagcactaaactcttcttctcaggagatgaggagaggtgaatgttttaaatggtttgtaagaaggcaacaactagctcaccagatatttccatttaaatcagtaattttcaatgtagtagtaattttgcctctcagggtacatttgacaatatctggagacagttttggctgtcacaactgggggtggggagggtgctactgatatttagtgggtagagtccaggagctgctgaacattttacaatgcacacaggtgccccgacaacaaagacttacctggtcccagatgtcagtggggtggacgttcagaaaccctggcttaaagagttgaaaaatatttattgacatttcttttcttttggagctcattaataagggaggccatagtacagagtttccatgatgtcctgtcccattaaagagttacccacagcgtcaccatatgaagaggggaagacgtaccctcttagggcccctatcgtggaggaaacaaatggaccctttactgagcacttgcgacgtgcatgacccacatgatcacattgaattccagggtcttgctgtgtacccaggctggagtacagtggcaggattatagctcactgcagtctcaacctccaaggataaaacgatcctccggcctcagccttccaaagcactgagattacaggcatgagccaccccttttggctgacatttctattttttttttttttttgagacagtctcgctctgtcgcccaggctggagtgcagtggcgcaatcttggctcactgcaacctccacctcccgggtacaagcgattctcctccctcagcctcccgagtagctgggactacaggcatgcaccatgacacctggctaatttttgtatttttagtagagacggagtttcaccatgttggccaggctggtcttgaactcctggcctcaagtgatccacctgcctcagcctcccaaagtgctgggattacaggcgtgagccactgcacccagcaccaacatttcttttggttggtttcaggcactgtgatcatgatctgtgctggttcgaggctttttttttgccccctctttagcgctgtttctgacctgcagtttacagtacagggtgctgttgtcactgccctgcctcttcagtttcagatgattgtaccaaagcggtgctgtcttgtgacagcttggctttccatggttgtccttttggcaagcagctgcagaaccaaagttgtggagtgcttgggatttgcggtgcccggcccatgccactcacctgctctcagttgtggagtggagcatgccagtgtcatttgaaggagctgcgtttgcaggaggcatgagagagcataagctgggatgagttaggaaggatggaaatacttggggtttggaagttgggtttttttttttaatgtttgttggttttttgtttgtttttgttttgttttttgagatggagtctcactctgttgcccaggctggagtgcagcggtgcaatcttggcaccctgcagcctccacctcctgggttcaagcaattctcctgcctcagcctcacgagaagctgggattacaggtgcgaaccaccatgcccagctaattttgtatttttagtagagacggggttttaccatgttggccaggctgatcttgaactcctgggctcaaatgatccacctgccttggcctcccaaagtgctgggattacaggtgtcagccactgtgcctggcccgtttgttggttttgaattaaaagtttagggttcccagtggggcatggtggctcatgcctgtaattccagcactttgggaggccgaggcggggggttacctgagctcaggtgttcaagaccagcttggccaacatggtgaaaccccgtatctaccaaaaaaaaaatacaaaaattagccaggcatggtggcggctgcctgtaatcccagatactcaggaggctgagccaggagaatcacttgaacctgggaggcagaggttgcagtgagccaagatcgtgccattgcactccagcctgggcaacaagagtgaaactccgtctcaaaaaaaaaaaagtttagagttctggactgtaaactgcacactaatattggaatttaacaaccgagatgatcatagtaactcttgttgagtaggaagttatttcgtttttaaccccgtttattttgctctctcataccaaaggtttgtcatagttgctgttgtttctactatgatgtcatttaaattgttagtatgcatccattttttttagaataaaatgagacttaaaaaacaaagctggctgggcacagtggctcacacctgtagtcccagcactgagaggccatgcagggtggaccacttgaagccaaaagttcaagaccagcctgggcaacatggtgaaactctgtctacatataaaatgcaaaaattagcccagtgtggcagcatgggtgtgtagtcccagctactcagaggctgaggcaggaaaattgattgagcccaggaggtcagggctgcagtgagctgtgttcatgccactgcactccagcctgggtgacagagtaacaccctgcctcaaaaaaaaaaaaaaaattatttctttaatagaaagctagtagccagttttcagaatattgaagagacaacataggcagcgtttcccatactttttgagggtggaacccctcttctgtggaacatctctagtggccagtgttccatggaacatactttgggaatatgcagttctaattaaagggggactgtgacaccacgatgtgtgcattatagtgtttgtgatgatttcagagctaggcaaagacaagctctatttgtttactcagcctttaatagaagaccaatcaataacctcagccattaaatcgccctgcctacttcttctatacacttagccattacttatgtctcttcatttttattttttctaagaagacggtaccatgcattatttcctgcaatattttacaggaagttcagactaattttaaggagaacaaaatgtacttttaatataacgcgatggtagatatttttgaaggaaatacaaaaaaattaaccgaggggtttttcgagtgccaacctggagtcacttgctcaaataggcactggggctgtgacagcaaacagagtggacctagtagtaattgcaggcggcatggcccaagcattaggtctgttcttctgggttgagttttttttttttctttttttcttttcttttttttttttgagacagagtctcactctgttgcccaggctggagtgcagtgacggcctctcggctcactgcaaactccgcctcccggcttcaagcaattctcctgcctcagcctccccagtagctgggattataggcacctgccatcatgcctggctaatttttgcatttttaatagagatggggtttcaccatgttgtccaggctggtctcaaactcctgacctcaggtgatccacccgcctcagcctccccgagtgctgggattacaggcatgagccaccacgcccagccaaacagttttttttgttttttttttttttttttttgaggggactctcacttcattctcacaacatctccacgaggtcgaggctccttcccctgtcttttagctgagcacgggcgtgcacagatgttaaactggtcctaggtcctgcatctaggaggcatcacaaccaggatctggacacgggagggccaactctggcaagctctgtgaaccaacacattccaccgggttggtttttctgattgttttttgtggtctttgcagataggaagcatgtgagaaactgaatcctttcaggtaatgagtcagatccttcgtggggtgatatcccttagggggaatgtgcctctgctgttttactggtagatgctgtcacccagcctgcagattgtgtgcactgaggacagggaaagggccgcagtcagctgcagggacaccaccgaacagacatgggcctggccttggtcagcgtcaggggaaaaacgagccctgatccactggtgacgctgcttctcttaaaaggatgcatgagaaggtgctgactttgtatcacgggagacctagataaagataagaggcgaacaaatgcccggcctcagcacaagagcccctgggagcgggagtcagcacatgcaggtgctgtgggcagactgaaaggaaacaccactccaggctgatggaatttgcagggtcgtgggaggccccaggcagatttgcccctagcatttctaaaggcagatgtcacttggcacatttttggctgtgctcaagttggtggcatctaattgcttaagtctttgatcagtctcctcagcatatgcttgtttttgatacaccaatggctccttccgcttttctgtgaagtggctgacctgcctatccctcttatggtggaacctcccttccgtgagcacctaggcatccgtggcacggccagggtggagatgggtctctgccctgccacgcacgactgcttagccactttccattggccaagacaccgcgctgcctagtgacattggttttggcaaatccagggtcagtgtgacagccagcaggtggacacacacagcagggtgagagatggcagcggctcccggcgatgaggaaggtggggcttccccagccaggcgaatccgctgtggttcttcatgcagcattcgcagagcagtgtgcagtgggactcgggaagatggggcgagcccttgaaccctatcctctctcatcaacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgggtgctgtgttcctcacagggcatggggaggaggcgacatgtgggcacagcatcctcatgggcaggttgtcactgaagctgcaaagggacatccaggaaagggaggtgcaccaagcttaagtctgggtaacgaacggctgagcaaggcgagaaggaggccttgtgcagttgaggctggtggtggcttttttaacatatgcattaaggttttttttgtttttgtttttgttttgagacggagtctcgctctgtcgccgaggctggggtgcagtggcacaacctcgactcactgcaagcttcgcctcccgggttcaagcaattctcctctctcagcctcccgagtagctgggattacaggcacccaccaccatgcccggctaatttttgtgtttttagtagagatggggtttcaccatgttggccaggatggtctcgaactgcctgcctggcgggtgatccacccaccgcggcctcccaaagtggcattaagattcatacattcaaataagtgttcacaccctcagaggtcccttctggaggcccctggctttgcagaaatgtgcttagctgcacacggcgctcagacggcctctgcacgcagagggtctgctgcattggcgggtctttgtttccttcctctgtcctgtgtcacgggggccactgcccactcacacatggaaaccccctcctcccttggcgtcctccccctcctctcttgtctccattggctgctctcaaacctaaattattggggtcccccaggtatccatctccaggcccttcaagggaagctctcttccctggtaacgacatcccttctcgtgcccttagaaatggtaacctcccagatctttgtctcttttccccaaacctgcctcttgtgcttttgtgtcttgctgtctttcgccacctggtggtgttcccacactttgatcttaaagtgttcagattgaattcgcaggtgagaagatctgcagctgagtgtgaattaccctctggttccatttctctttgcaaaatgggggttgtagacctgcttcacaggatctctctgatgacaaggtggaaaaatggatgaaaagcgcctcgcacaatgatcaggacacaggcgaccccgatgaacacgtccctttcctgccccgtcagtatcccctttgtctctttctctccatcgtctcagccctgctctggcttcttgtctcttactcttggatctgactggtttcttcccatcccaaatctgctaagagatttgggatggggagaaagcctagctttgctcatatgtatcctgtgctttaaaaatgtctgacttcccggctgggtgcggtgactcatgcctgtaatctcagcactttgggagccctgaggcaggtgaatcacttgaggtcaggaggtcaagagcagccgggccaacatgatgaaaccccacgtttattaaaaatacaaaaattagcctgggcgcagtggctcatgcctgtaatctcagcactttgggaggccgaggcgggtggattacctgaggccaggagttcaagaccaccctggccaacatggtgaaaccccgtctctactaaaaatacaaaaatgagctgggtgtggtgatgggcgcccgtagtcccagctactcaggaggctgagacaaaggaatcgcttgaacctgggaggcgggggttgcagtgagctaagattgcaccactgcactccagcctgggtgtcaaagcgagactctgtctgaaaaacaaacaaaaaaaattagcagagcatggtggcgggcacctataatcccagctactcagctgtctgagacacgagaatcgcttgaacgccggtggcagaggttgcagtgagtcaagatcacaccactgcactccagcctgagtgacagagcaagaccctgtctcaaagaaaataaaaaaataaaaatatctgacttcccattgccaacagctatagtccaagctcaagagcattctaaccatctgctcccagccacagcacctcactcttccctgcaggccctgcgctcccacacgactgccacagggcctggcctcacagtgcctttgctcccggctgttcccttctgtccccctggctgtgcattcctgcccttcttcgaggtctcagtgtagctccttcctgttcttcaagcccagctttcccgtggagcatcattgttctctgcagttgaaagagctctcctcttctgaactctgagcgtttgtctgtggctctaatttcttatgcatctctagtctacctatctgtattcagaaaagacactcagaatatctactgaattgatcaggaattattttcccatgtgtcttcagagctttagtttaaggttcctgttggatcctttctgggatcgtagaatttgagatcatagaacccggccatctggtccaaacccctccggctctcacgtggaacagtgaggtctgcagctgaacgtcttctccgatgtcacgcagcctgtggcctcgagagctagaacccacaccctcctgacctgtggctgctggttctcttctgagtgatataacgcaggagtttcaagattcccgggaaaggttactttcgtttttatgaccataaagagtagcctgaaaatgctagtgccgtttgatcgtttacaggtgaagtctttgcgtgcctccctgttggactcaaatgttcttgtgcaaagaaataatctggaaatcgttctgtttttcttcccattttatacctgtctggtaagtaatttgtactcttctggtaagtcactggtgtttcccaaggggtgggatatagatctcaagcagttctgtcgtacgaggacagctcagccactcatgggcattatttgctggtagccagtgaaaagtccttgttcatttttgcaaggatagcgttttcattgcacgtattgaatagcttctttccatgggtaatgtgtaaggaaccagcccattttgagatagagctttgcagaccagcaaggaagggctgcgtgtcaaaaagtcagcaatctgccctatcattcccttgcagtaaatttctctgtccttctaataggattccaatgagagagccatccccctcctcagatctgacatcgtgcgcattctctcagccgccacccagaccctactgagaagggacatgtccctgaacagaagactgtatgcatggttactaggtactgagcagtatacacccttttaaagtcaaagttaatatgaaaccttttagtgctgacttctggaataagatttggtcttggtgatgtatctctgaatcatgaagtatggaaagataccacaatgactaaatatggcactggtcagttgaggtctgctgcctacacatagcttggttattttgcagtttcttttttaaaaaaggggaaataataagtgggatttttaaaatgccaactgaattccatttaagagcttgaaataccaccaaaaagtggtagcaaaaccttattcaggtagaagcctgttgctatggagaagttccatgggatgagggtgtatcgtggagaaaacttacaaatattgtggaagatatgtagataaaggaggaggttttgtgtaagtgtaaatgttttgggagacatttggataactttggagatcacgagagcccctgggccatgtttctgtgtgtcagagtgtgtggactgcctataaatttgttggcaaagggcccttgactattggttggaaggcctcccagggacagagcctaggaaattgcaactttaaagataacacgttcatgaattttctaaagtcccatattcacgtacctaagaaaacgtatacaaaacgattgtgacaggacttaacagctctgatcaactctcaacatttagatcttttttttcctttttgagatggagtttcactccgtcgcccagactggagtgcagtggtgcaatctcagctcactacaacctcggcctcccaagttggagtggttctcctgcctcagcctcccaagtagctgggattgcaggcacccaccaccccggctgggtaatttttgtatttttagtagagatggggtttcgccctgttggccaggctgatcttggactcttgacctcaggtgatctgcccacctctacctcccaaagtgctggaattacatgccaccacactcagcctagcattcagatcttatcaaagatcttaccaaagtcaagaagtcctcttcagtccttcctgctgttctccctagttataaaactttagaaagtcattgcatggaagcttactaaggattttaagaagactatttgtaggctctttaaggatttgtatgtaaaggatgattttgtcaagggcacagctctgctcctacgggacttgatatgctgtgtggaggacactgggcctgaccacagtgccagctctggctcacttacttgcggccccaggagccccatattctttgcccataccatgaggatgcactttcttgccctgagaaccttgcagacttatccagggctccagctgatgggagcatgtgcatgagaataccttgatctcacataatgctggacaaaaaaacactggttttaaaaagtgatcctcagccaggcatggtggctcatgcctgtaatcccagcactttgggaggccgaggcaggtggatcacctgaggtcaggagtttaagagcagcctggccaacatgctgaaaccccttctctactaaaaaatacaagtgattcttctgcctcaacctcccaagtagctgggattacaggtgtgcgccatcacgcccggctaattttttgtatttttagtagagacggggtttcatcatgttggccacgctggtttcgaactcctgacctcaggtgatccacccaccttggcctcccaaagtgctgggattacaggcgtgagccaccgcgcccagccaacagggtgaattcttagaacaaactaaattgatacccattgaggtggaattctgcctgtctgatcattagccacaccactgtcagaagaagaaaatctgacgtggtctttctggatctgattttggttttccatcagaagaatgatatttttaaaaatattggagcatgagacttttgcacaatatgatgtcctttaaaagcacagctctctttacagctcggcgcttgttcttttgtaggctcagacataaaaggaaataccgttgtgccagaatctgaaatctcaaattcttatgaagaccagtcgtcttatttttttgaaaaatactccaaggatcttttagttgaggtaaaggagcatttccggaaagttcagggtatccttggtgacgattctccagtggatttctttgggaggcttccacataggcagtgagcacgttccttggcccctggtttggggaactgcagggtatttgttgcatgctgggtgactggttttccttctgtcccagagtatttaacaattagaatagccagtaatgttgttacactttatgatatacgatattctaatatgtggctttttttaaataatagggtttggctgagatattgcatcagaagttcatagatgctgacgtggaggaacgccatcatgcatacctgaagccttttcgcgtcctcatcagtctgcttgacaagccagaaataggtaatgttagaaatgctgcttctatcctatgctgaatacagattacctgttttcagggaaatacaacatggtgagatacaaccaaagcgttattttgaatataatttaatatttggaatttcacaactttgaagtcatgttatatggttcaatgatcatatctgtggtcacttacaagttttgcatggctgggcgcagtggctcatgcctgtaatcctagcactttgggaggtagaggaaggaagatcacttgagctcatggatttgaaaccagcctgggtaatatggctgaaaagccatgttgaaaaaccccatctctataaaaaaatacaaaaaaattagccaggcgtggtggtgcttccctgtagtcccagctaccaagtggctgaggtgggaagaccacctgagcccagggggtcgaggctgcagtgagctgtgattgtaccacggcactccagcctgggcgacagagtgagacccagtctgaaaaaaaagttttgcacaataatttgaacattttttgttaggaaaatacctttgagctcctatagtgtctacagaacatgtggtatttcctttttaagcctattttttcaatgtcatacttaaaatgagctttggtttgattttcaattaagtaggggaccccgtccatctttttgccttgggatcctgggcaagccacttcttttcactgtggagagtaaaaacattttcactgtaaaatgaagagggttgaactagactctggtcaccaaaggctcccttcttagatactatggtcctatgagcataggttgagaaaagtgaccttctctcactatttatttatttatgaatgaatgaatgaacgaatgaatgaatggcagagtctcgctctgttgcccaggctggagtgcagtggcgcaatctcggctcactaaaacctctgtctcctgggttcgaacaattaattctcctgcctcagcttccccagtagctgggattacaggcatgtgccaccatgcctggctaatttttgtattttcagtagagacagggtttcatcatcttggctaagctggtctcaaactcctgacctcaagtgatccacctgcctcggcctcccaaagtgctgggattacaggtgtgagccactgcacctggccctctccctcactttaaaaagaaatttgcgaccaggcacggtggctcacacctgtgatcccagcactttgggaggccgaggcaggtggatcatgaggtcaggagttcaggaccagcctggccaagatggtgaaaccccatctctactaaaaatacaaaaattagctgggcatggtggcgcgtgcctgtagtcccagccactcgggaggctgaggcaagagaatcgcttgaaccagggaggtggaggttgcagtgagccgagattgcgccactgcactccagcctggcgacagagcaagactccatctcaaaaagaaaagaaatttgcggccaggtgtggtggctcacacctgtaatcccagcactttgggaagctgaggcaggtggatcatgaggtcaggagttcaggaccagcctggccaagatggtgaaaccccatctctactaaaaatacaaaaattagctgggcatggtggcgcgtgcctgtagtcccagccactcgggaggctgaggcaagagaatcgcttgaaccagggaggtggaggttgcagtgagccgagattgcgccactgcactccagcctggcgacagagcaagactccatctcaaaaagaaaagaaatttgcggccaggtgtggtggctcacacctgtaatcccagcactttgggaagctgaggcaggtggatcacctgaggtcaggagttcaagaccagcctggccaacatagtgaaaccccattcctactaaaaatacaaaaattagccaggcatgacagtgcacacctataatcgcagctacttgggagtctgagtcaggagaattgcttgaacccaggaggtggagattgcagtgagctgagatcgcaccattgcactccagcctgggcaacagagtgagactccgtctcaaaaaaaagaaatttgctaccatatcagctcactttaaggtctgcatctgcttatgtgagccctataccagggaaaagatccccatgtcttccataggattgcaagcctaagaatgtcatttcagtgctccaggtgtacctacctcctggtagctgtttgcagaggacaagagagctgagggctggccgggtgtggtggctcatgcctgtaatcccagcactttggaaggccaaggtgggcctcacttgaggtgaggagtttgagaccagtctagccaatatggtgaaaccccatctctactaaaaatacaaaaattatccaggcatggttgtgcacacttgtaatcccaactacttgggaggctgaggcacaagaatcacttgaatctgggaggcagaggttgcagtgagcagagttcacaccactacactccagcctgagtgacagagcgagactccatctcaaaaaaaaaaaaaaaaaaaagagagctgagggcattagtgaagtggcctctctctggccttgggatggaggcccttcgcttatccattcaaaagcacagagcatctgccatgtggcagggatggtgccagctctagggggacaaaaggggagcagcttctcatgaagttagagggaaggggagactccatgttcctggagtgtttttactgttcattaataataaccatggctgacattttttgagcaattattttgtgccaagtgatttacatacatccttttatatctgtctgcacacacacctctgtccctccaacaaccccaaggtaggttctcccactatgcctgttttacaaatggaaagactaaggttgggtgggagtaggtaatttgcccagggccagtcaggagcctaagctgggtttgtcagcaccccccgatgcttgcctgattgcactcagagaagtcctacccgagatgtttgcctctgtcaccaggtgaactttattccaagagttgtgcagctctcgtcattcttaacgaaagtccaagtatgaagcttttgttcttccaggctctgcccatgatgtgctgcctcagggtgtctgcactttgttcagattcctcttcccatctgcccgctcccaccttaaaccaaatagattttcctgctagtgtagagtaactgcagctctgaaaaatcatgatttagtccaaaaagtggaacacttatataaatgtattgggagcttgctgtgtaacttcagggaagtattaaaagaagaaaatataacttagcattctggagatgtgtgttttatgtcaaagccatgcaccttggtgagccaagtaaacgttgctgctaacttggctccaggtcgtattttctggaagcaaatgaatatcacgctcctgcccaatcataacagtcacttaatttactctttccaattttttagctgtctgcaagaaatcacactcaggaggcaaaggaggtgattatacagaactagaaggcacaggacggccattcagtccagtccatactttttgtggctgggctttagccatacctcatttcctcctccatcaatcaaggcaacaaaattgccttcatttttgtaacaagcatttagcattcttatgctgtagataaaatacacaggaagccaaggccaggtgcggtggctcacacctgtaatcccagcactttgggaggccgaggcaggcagatcacctgaggtcaggagttcaagaccaacatggcaaaaccccacctctactaaaaatataaaaattagctgggcgtggtggcacacacctgtaatcccagctgcttgggtggctaaggcgagagaattgcttgaacccgggaggcggaggttgcagtgagctgaaatcatgccactgcactccagcctgggcaacagagcaagactctgtctccaaaaaaaataataataaattctatcttaaaaaaaatacacaggaaacttagcatgaaaataattctctcagaggcacatcttttggttttgtgaaaagaagtgtaaaagattggattaatctgcttttttgccagtgttgacagagctttcattttctctgaattgattgtgtgtttctgcctttggatacatgggtaagaagtcaggccctcagctgcctgagggttgcggtttgcggagcagcaatgccctgcccatcccctgcctggttgcagggaagcttctctaacatgcagctggtccagttcttttgtgccatctttctcagcgtttcaggatagccatcatttcttttgtgttgctccagctcatgactaaaggaattgaagaagttgccctgctctctggatatttctgttgagtaacgtccctggccagcagtttatgcacacttaacacacgtagtctgcgctctgcctctatctagcagaatctgctttgggcaagttacttaacctctctgtgcttccatctccttatgtgtaatcagcagtacaggatctgtctgcatggctgttacgagggtttaatacgttaatagatgtaaaacgcgtagaagggtgtctggcacacaggaagttctacaaaaatgttggctattttcatgaatgttgtttccccagctaaagttgtcaccagtaaagttaagtttctgtatattttagactatataaaatgtctgtctgcacaggtttactgtatatatgtcttatgtatatacatatgtcacttactgatttaaaggggattgttaatctgtctctgaccatcttccttctaattacagggcctcaagtggttgggaatttgtttctcgaagtcatcagggccttttattcttactgcagagatgcccttggctctgatcttaaacttagctacacccagagtggaaattcgctgataaggtatgggtttggccttgaacctcacgcatctctctccctccccggtactgtgattttttttttcctctcttgcttactataaattgtgaagtggtagagaaagcagagatgcagcaggtgagaccattggtgaaaataatcaatgcgttgaagtcagtccatgggaattgactgttccctactgagtacggtgaagagtttaaagggagtttgatatagtctttcccccagcctgggatggacaggtatttattgattttttgatcaagtatgaaacaatgaaatgtatgtattgatcaagtatgaaactcgtttaacaaaggcagcttgatctagtatacccaagtggtgagttacagggcagagagaacagagaaaatggaggggagggcacctggcaagtggaaaggggatgtgagtcttcaggacaggagtccagggggtgttgggggagattgggggagacccaggcagggcaccggagagcacaggctccattcccccagaggcagagtgagtggtgtttggaagacagcgggcacattggcctcacgtgcgcagttacacacaaaccctgttttgtttgtttattttgttccttttaagggaatacaactttttcctttttgctttactcttaatgtaatttccttctgcctgaactagcattgggtacattgaaaatttaaatcaatgttaatatttttctggtttgttagttgtaagtgtactaagagttcttagtgtttgcttttttctcccagaatgaaagcggtttattgtttttctgagtatgaaagtaatacatgctcattgttgcatttactgatatttgaaagatcaagaaaaaaggtgtcacacgtaatcctagcactcttcagagaaaaccataaaacatttttacttctttctagatttctactacatacataaatacatagatgcctgtcttttattttaaaggtagaattacaccagttatttagttgcttggggttttctttttgttttcttgttggtttgtttgtttggttttgagacagggtcacccaggctggagtgcagtggcgtgaacatggctctctgcagcctcagtctcctgggctcaagcgatcctcacgcctcagccccttaagtagctgggactacagacatgcaccaccatgcccagctaattttttttttttttttttgtggagatgaggtttcaccatgttgctcaggctggtctcaaactcctgagctcaagcaatctgcccacctcagcttttcaaagtgctaggattataggtgtgagccgccatgcctggtactctctggagtgtcactctccagcatgacaaggtctcactctgtctcccaggctagagcacagtggcaccatcaatggtcactgcagccttgaactcctgggatcaagtgatcctcacacctcagcttcccaagtagctacgactataggcacacacaaccacacctggctaatttttaatttttctgtagagacaaggtcttgctatgttgcacaggctggtcttgaattcctggcctcaagcagtcctcctgcctcagcctcccaaactgctgggactacaggtgtgagccactgtgcccggccactgcttgttttttaaaatgcaagttgtgagtagctctacactattctcctatgggattagttgccttagatatttgttaaggatttatcatttatttaaggccaagtgcagtggctcacgcctgtaatttcagcactttgggaggccaaggcaggcggatcacttgaggtcagcagttcaagaccagcctggccaacatgacaaaacctggtctctacaaaaaaaatacaaaggttagccgggtgtggtgggccatgcctgtagtcccagctacttgggaggctgaggcatgagaattgcttgaacctgggaggtggaggctgcagtgagccaagatcgtgccactgcactccagcctgggcgacagagcgacacttcatctcaaaaaataaataaaaataataaatcctgactgaccaatttcttattgattgacttttagacagtttctgctttttcagttttgtttgtttgtttgcttttgagacagagtcttgctctgttgcccaggctggagtgcagtgatgtggtcttggctcactgcaactccacctcccaagttcaagtgattctcctgcctcagcctcctgagtagctaggattacaggcacctgccaccactcctggctaattttttgtatttttagtggagatggggttttcaccatgttggccaggctggcctcgaattcctgacctcgtgatccacctgcttcagcctcccaaagcactgggattacaggcatcagccactgcgcacagcctgtttgtttgtttttgagacggagtctcgctctgtacccagcctggggtgcggtggcgccatctcggctcattgcaacctccacctcctgggctaaagcaattttcgtgcctcagcctcccgagtagctgggattacagatgcccactatcatatctggctaatttttatgtttttagtagtgacagagttttgccatgtttgccaggctggtctcaaactcctgacctcaagtgatctgcctgcctcggcctcccaaagtgctgggattgcaggtgtgaactaccacacccggcctttttcagtattttttaatggccatttagtggtacacttctgcacacatctatgtagctgtgcagggatttcggtaggataaatttcttgaataaatttcctgagccatagaagataaaatttaaggctggatgctatggcttatgcctgtaattccagcactttgggaggctgaggcaggtggatcacttgaggtcaggagtttgagaccagcctggccaacatcacggtgaaaccccgtctctactaaaaatacaaaacttagctgggcgtggtggtgcacgtctgtaatccatcctagctactcgggaggctgaggcaggagaatcgcttgaacctgggaggcagagattgcagtgagccgagattgtaccactgcactccagcctaggaaacagtgagactgtgtctcaaaaaaaaaaaagaagataaacatttaaaatcttggctgaatttccctgctgaatatccatgtaccatgttattccaccagtagagtatggactaaaactgattttctgtacaaattctttttacagtagctctgaaattattattattttatttttatttttattttttgagacagagtctcactctgtcatccaggctggagtgcagtggctcaatctcagctcactgcaacctccgcctcccaggttcaggcgattctcccacttcagcctcctgagtacctgggattacaggtatccgccatcatgccctgctaatttttgtatttttgtagagacagggtttcaccatgttggtcaagctggtgcacccacctcagcctcccaaagtgctgtgattacaggtgtgagccaccgcacccagctctgaaatttatttttaagagactgtatcaatataaatattgtttacgatggcattatgcaaacacattataagaacagtaatattttcatttttatcagggtgtgtcagcttctctagaaataagttgcagatggtgaaatcaattacagttttttggacactttttgtaattcaggatttttttatagacatatttattcatgtcctccccttttacagtgcaatcaaggaaaacagaaatgcctctgagattgtcaaaacggtaaatttgctgataacttctctaagcacagactttctctgggattatatgacaaggtgttttgaggaatgctttaggtaagtatgcagttcaagaatgcagaatatttaggaaggatgagagggtttaataattttgtagctgcttagaatatcagattatatataagtagctgaagctgagtagtctttcctgagttttaaaattcaactaaaacaggattggaaagaattcacttaagattctagcagaataaaaacatctccaataagaaggttcacataatctttgccatgtaattctgaagctgctttaaaagtctaactttagaaaatcctcagcgcattttctggttacattcatcaaatcagctttcctctcctggctgcccgatctattgaaagcagcttagttttgtggctttgtgactggatagagtgtttttgaaactcttgctgaaatgaatgtaactggtcagataaaagcattaatgttttaagctactataatcagctttaccatctcttttaaccgggtgaattgcaccacccctaaattgtttgcagtggcgtaccccaggaataccgagctttcctggagagccctttcccatgccattttctttacgggaggaataaggtcatgtctcaaaccctgttttgtcctgaggcatgctgtaaaacttatttcttgttcatctccactgtaatgctcttggctgtttcagagtcttacttctcagctgctaccactacacttttctgcccaaataagctcacaaccctgggaaaaataagttaattgcaattggatccacaggcaacagcaaggccatattatattgaggttagagtatgctttggtcagcctggttgttatgttattttttattttatgacggagtctctgtctctcaccgagactggagttcactggcacgatcccagctcactgcaacctctgcctcccaggttcaagcgatcctcccatcctggcctcctaaatagctgagactacaggctcagcctcccaagtaactgcgactacaggtgcacgccaccacacccagctaatttttgtatttttagtagagacagggtttcaccatgttggccaggctggtcccaaactcctgacctcaagtgatccacccgccttggcctcccaaattgctgggattacaggcatgagccgccgcatctggccatcctggttattaaaaaaaaaaaaagaataaaatgtttctacccagatagagctgactctccatctttgcaacattttgtcctcttttcatcccagagttaatccctgtcctgagattaatgtctgtcttcagtgtaacatggctttgctgttgcctgtggatcctattacagttaatttattcatcccagggttatgagatgaaaagcaatagatactttttaacttacccatttatctagtagcctgtttattttaaaagaagtcttgaatttcagtataagataagcaactaacaatagttgattggtggggttacacttctctacagaagctgaaactttctaggcaactcaggtgctgataaactcctggaattacttggagaggagtagtcccaggccactcctacagcagggtgaacagccatgtggactgtggtgttctccagcccagcctcgttcccttggatcgtgcttttgggcttggactggggacttgggattacatctgtcgatggtactccaggtctcctgggagacacctgaattggtagagttcaagtcagagggaatctgtttggacaccaacagattcaggacacttattgacacttctacatgttagatacttttagtcaccaaaatttagttatgagaactacaaaagctgccttccattatgtttgaagtagaataacgttactggaaattgtaagaaatgcttggacttaccgcaggaagaagaattgattttttttttttttctgagacagagtcttgctctgtcacccaggctggagtgcagtggtgcgatcttgtctcactgcaacctctgcctcccgggttcaagtaattctcatgcctcagcctcccaagtagctaggactacaggcgtgggccaccacacctggctaatttttttgtactttagtagagatggggtttcaccatgttgcccaggctggtctcagactcctgagctcagacagtccacccatctcggcctcccaaagtgttaagattataggtgtgagcctccatgcctggccaaagaatggattttttctttgctgtgatttatagaccagtgaagcagcgttacagcgtgaggaacagcgtcagccctccccccacggtctcggagctctgcgccctcctggtcttcctgctggatgtcattcctttggtgagtgctggggaagggacatctcaacgcctgctattatttacattcttactggtggtgatggcctgctttatcaacctcacattactgaaaatgttttacataaatatgcaacactgttttgatgtttgttttggcataaaagatatagctggatgtaatctcttaaatttttaatgtcttatttaaaaggggctataacttttgggccagttgtaagtgggcaaagctgaagttaggtcaaccagctgaagaactgggtatcattcccgtactacagttactttagggaaagagtcaatacatttcctagttaaaattgtgctgttggctaattttctcaaaggaaactaatttccttaatgtagaaacgtgccaattttattttttattagaaagtgtaaagccacttgcaaggagaggagtaacatccttgatttgtctagatcaaattgaaataccgagcctagctctgtggtatgcgctcgtaattcccagctactcaggaggctgagattggagcattgcttgagcccaggaatttgagaccagcctggacagcataacatgatccagtctcaaacaaaaacaatagaaatgttcttttcttttctctgtctctctctctctttttttttttttctcctgtgacagagttttgctcttgttgtccaggctggagtgcaatggtgtgatctcggctcactgcaacctccgcctctggggttcaagtgattctcctgcctcggcctcccaggtagctgggattacaggcacctgccactacgcccagctaattttttgtatttttagtagagacagggtttcaccatattggccaagctggtcttgaactcctgacctcaggcgatccaccagcctcggcctcccaaagtgctgggattacagatgtgagccaccatgcccatcctcttttctcttttttgagatagagcctcactgtcacccaggctggagtgcagtggcatgatctcagctcactgtagcctcatcctcccaggctcaagcaatcctcccacctcagcctcccaagtgtctgagaccacaggcatgtgccaccacatctggatagttttagtattttttgtagagatggggtctcactgtgttgcccaggctggtctcgaactcctgagctcaagcaatctccctgcatcagcctcccaaggtgctggctgggattataggcatgagccactacgcctagtcttcttttgttttctgatttgaaaattaatatggtatggtggctcacgtctgtaatcccagcactttgggaggccgaggtgggcggatcacaaggtcaggagattgagaccaccctggctaacacggtgaaaccccgtctctactaaaaaaaatacaaaaagttagccgggtgtggtggcgggcgcctgtagtcccagctactcaggaggctgaggcaggagaatggtgtgaacctgggaggcagagcttgcagtgagccgagatcacaccactgcactccagcctgggtgacagagtgagacttcatctcaaaaaaataaataaataaataaataaaataaaataaaataaaaaagaaaattaatgtgggtcaggcacggtggctcacgcctgtaattccagcactttgggaggccaaggtggatggatcacaaagtcaggagatcgagaccatcctggctaacacggtgaaaccccatctctactaaacatacaaaaaattagccgggcgtggtggtgggcacctgtagtcccagctgctcgggaggctgaggcaggagaatggcgtgaacccgggaggctgagcttgcagtgagccgagatcgcgacactgcactccagcctgggctacagagcaagactctgtcaaaaaaaaagaaagaaagaaagaaagaaaattagtgtgaaatttatgccctaaaaaattgaattagatgccattttgagatgcattgtttttctgattgtgaaccaacattgtggggttaacctacacgtttatttcacaggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcggtgtgtactctgaggggcagaaatggttctgggggctaaaagcagcttatgccttcctgggagtagaaagtctttagggttggttaggataggaataaagatgagaagatacccaggtgatatgtcaaatatgcttgtaaaaccctcactttaaaaggttttagcacctggcatggtacaatggctcacacctgtaataccaacactttcggagactggggcaggaggattgcttgagcccaggagttcgagaccagcctgggcaacatagcaagccttcatctctctacaaaataaaaattaggccaagtacagtggcccacacctgtaatcccagcactttggcaagctgaggcgggtggatctcctgaagtcaggaattcaagaccagcccaaccaacatggcaaaaccccatctctattaaaaatacaaaaattagccaggcatggtggcacatgcctgtagtcccagttacttgggaggctgaggctggagaatctcttgaacctgggaggcggaggttgcagtgagccatcacgccactgcacttaagcctgggcaacagagcaagactccgtttcaaaaaaaaaaataaataaaaataagggctgggcgcggtggctcacgcctgtaatcccagcactttgggaggccgaggcgggcagatcatgaggtcaggagatcaagaccatcctggctaacatggtgaaaccctgcctctactaaaaatacaaaaaattagccgggtgcagtggcgggcgcctgtagtcccagctactcaggaggctgaggcaggagaacagcgtgaacccaggaggcagaccttgcagtgagccgagatagtgccactgcagtccagcctaggcgaaaaagtgagactctgtctcaaaataaataaataaaataaaataaaataaaataaaataaaataaaataaaataaaataaaaaggcatggtggtgttcacctgtagttccatctactcaggaggctgaggtgggaggatcgcttgagcccaacaggttgaggctgcagtgagccatgattgcacggctgcactccagcctgagtgagagcaagaccctgtctctacaaaaaaaaatttttaagtttagcaccctttgtttcacccattctcatgctacttgcctgctctgtaactgcagttaatggttagatacagttaataactatgtaactacagttaatgggctagttataactagccctgcactgttttatgtgtgtgtttgtggcatgtgattttggttatttcgaatataagcgagatgaggtactggattagtttgctgggactgccataataaagtaccacagactgggtggcttccacaacagacacttgttttctcatggttttgaaggccagggcctgacacgaaggtgtcagcaaggttggcacctcctgagtgcactggggaaaaagagtctgtctcatgcctcccccgagcttctggtggtttgctggcaatattcagcattcctcggcttgtccaggcatcagcccagtctcggcctttatgttcacttggctgtcaacctgtgtgcatgtctgtctctgtgtccagatctctcctttttataaatccagtcctactggatttgggcccactctaatgatctcatcttaattggatcatctgcagagactctattttcaaattaaggtcacattcacaggtattgggagttaggacttcaacctatttttgggggacaccgttcaacccataacgtacactattctctgacttgctttaccttttttttttttttttttgagacagagtctctctctgtcgcccaggctggagtgcagtggcatgattttggctcactgcaacctccacctcatgggttcaagcgattctcatgcctcagcctcccaagtagctgggattacaggcacccaccaccatgcctggctaattttttgtatttttagtagagatggggtttcaccatgttggccatgctggtcttgagctcctgacctcaggagatccacccacctcatcctcccaaagtgctgggattacaggcatgagccaccacacctggccttattttatttcttcatacctttattttaccctcagctcagtttcctcattcatatttgttaatttgtcggaaacagttctcgctctgttgtccagagaattgtggcaggtgatccgcccgcctcagcctccctaagtgctgggattacaggcttgagccaccacgcctggcagaaacaattcttaaacaacttttttgaactctaaaggggttatatatttagacaaaaacacaagaaaaataggcccaaaagccagcctccccagagagcatgtgggtgtaccagcctcctctttgctacccaccgctctccttctcctgctttgggtgcctcctaaatttcattatacacttaacacagggattctctagtctggagagtgatgattttgaaaaacagaattgaaatacattcatgatttcaactgatacttaaatagcttggtgttaagagatgcacaattcacatctttttattttttacagagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggtgagaggcagccctgccgaagtccctctttgggaatcatacgatgaggcgattgacgtgggtggaatatcccctatccacaatgctagggaccaaatgtattttggatttcggacttttttcagatttttggaatatttgccttacacttaccgattcagcattcctaatccagaaatccaaaatccaagagctccagtgactgtttccttcgagcatcatgtcagtgctaataaggtttcaggttttggatttggaattttcagattagagattctcaacctatatttaaagactagctcaaattgtgtaagccaagaaggtgctattggcctcatttgttcccttcctcatttgtaattagtacatttttgacttgtgtctcaccacatggcaaagtggtaagggtggggcctatgtttttaaaccctgggtgtccagcacagcccatcagaagacctagaacatgagtggcattcagtgatagtaaatagactatttcatgatgcctgttgataaagttttttttgtgttgggtttttttgttttttttttttttttgagacagggtctggctctgttgcccaggctggagtgtggtgacaccaactcagctcactgcaacctccgcctcctgggttcaagtgattcttctgcctcagcttccccagtagctgggactacaggcacgtgccactacgcccagctaattttttttttttttttttttgagacagcgtcttgctctgtcgccaggctggagtgcagtggcgcgatcttggctcactacagcctccgcctcccgggttcaagtgattctcctacctcagcctcccaagtatctggggttacaggcacacgccaccacacccagctaatttttgtatttttagtagagacagggtttcaccatgttggccaggatggtctcaatcttttgacctcgcgatccacccgcctaggcctcccaaagtgctggggttacaggcgtgagccactgcacctggccccctaattttcatatttttagtagagatggggtttcaccatgttggccaggctggtctcaaactcctggcctcatatgatctgcccgccttggcctcccaaagtgctgggattacaggcatgagccaccgtgcctggccaatattttatatattggtttgctagggctcctctaacaaagtaccataaactgagaaatttgtctcatagttctggaagccagaagtccaagatcaaggtgtcagcagagccatactcctcctctgagaccctggatggaatactttttggcctcttcagcttctggtgctggccggcaacccttggagggctcctcaccttgcagctgcatcagtcccgtctctgcctttgtcttcacagggtgtcctctgtatgtcctgtcttcccttgacatgtccctcttacaaggacaccagtcatattggattagggcccaccctaacaacctcatcttaatttgattacctctgtaaggaccttatttccaaataagtctcaccagcgggaggttagcgcactgctgtccaggtggatttctcaggtaacttcccagatctagggtgctgtagaatctgcagactggggacccattctcacgtggttctgcttgtttctgcctctccggctggcttcctttcaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcaggtatttcccactgggaacactcttcttatggcctccttctccccctgagcaaaactcagaaccgtattgctggggatgggggcagtggcccacttctctgagagtgatattctatagggcactgggcagaggcagtagcctttggtcttcctctcccagcatgtaactttcaccctccaggaaagctacagtgagagcaactggggccccagtattctgggcctgccaggactgagtggaacccctgcctgggagtggggtctgggtggaggcagggagcccatgactcctccactgcactcacctggatttagcctctgccacatccagcagaggggtgggaaggtgacgtgctggtggcctgcccctcccaggaggtgcaaaagcccttgactgggagctggggaaagagagcacccttttgcttggccacatgcaccagagtggatagtgacgtttccatggagctaagctggggaaggaaggagatgatgagcaggtcatggctcaagtgccatgactcttgctgctttgaccgaaatgtcgtaggttttccggaataaatgtttctttatttcctgaatgtcctttggataatttccagactctaaatggttggttgttgttggttttaaaataattttcaccagttatggttgtgttgcttgggagagggtctgtctgtggaactcctcacaccgctcagctttggttccatgtgggacaccatctacggtgtcaggtcctgggggagcttttacttaattgctcattgactttttttgttgttgttgttgagacggagtcccgctctgtcacccaggctggagtgcagtggcacgatctcggctcactgcaacctctgcctcccatgttcaagcaattctcctgcctcagcctcccgagtagctgggactacaggcacctgccaccacacctggctaatttttgtatttttagtagagatggggttttaccgcattggccaggctggtctcaaactcctgacctcaggagtttgggaggcccgcctcagcctcccaaagtgccagaattataggtgtgagccaccgtgcccagctgcttattgacttttgtaccacatttcttcttcctgctagagttgagtcacattagatcttgaatagacagaacttgaaaccaggactggaaccgctataagcagcagtgattaagcaagtgtcatcttggccctacatagatcagagatcagaaaatttggcatatttacactatatataggcacaggggagaaaaaagaagaaagaattgagatcatgaatctttggaaaggtactcatagaataaaagtggcagcattaaatacattccttttattttggggcagtgagggaagcttttccaagttcttactgaagccttgatttttactttcattttcatgtagtacatattcaagtacttaccatttgcctggcactagagcatacttttcttttttttttttccttgagacagagtcttgctctgttgcccaggctggagtgcaatggcatgatcttggcctctgcctcctgaattcaagcgattcccctgcctcagcttccctggtagctgggactacagatgtgcgccctcacacctggctaatttttgtatttttagtagagacggggttttaccatattggccacgctggtctcaaactcctgacttcaagtgatcctcccacctcagcctcccaaagtgccttacaggcgtgagccaccgcacccggccaagagcatactttttttattgacatgtaatattgtatatatatatgggtacaatttgatattctgacacatttatacattgtatgatgatcaaatcatggtaattagcatacccatcaccttaagcatttatcatttctttgttgtgaaaacattcagaaccctctcttctagcaatttgaaatacacaatgcattattgttagcagtagtcaccctactgtgcagtagagtaccaagatttattccttggagcacacttttatgtactgtacagttcttgagagttgaggacagcggcagctagtgcctgtccctgttgcagatgctggaactagagacacagcaaccttacccatagccaggacgtgcccccaattctcagactccagacagggctgttgtctgatctttcagcctttttttaatcctgcgggaacagctcacataccagagttcctgcttcccacagtgcaaacaagaaaaggtcagatagcccaagggtgccctgacctttcttatcaggtagtgttggcagatttcagataactaagacaacacccagaacagaggagtagagtaaggtttaaacatgtgaaggaaggcccggctcggtggctcacgcctgtaatcccagcatccagcactttaggaggctgagggctgcttgcttgagctcaggagttcgagaccagtctggccaacacggcaaaatcccatgtctaaaaaaaaaaaatacaaaaattaacctggcatggtggcacacacctgtagtcccagctacttgggaggctgaggtgggaggatcacttgagccaaggaggcagaggttgcagtgagttgacatcgtgccactgcactccagcctggggcacatagtgagaccctgcctcaaaaaaatatatatgagggagtaggtatggatttgtgatcggcatcaactctcaaaaaccttgcaaaaaaattttttaaaccttccggaagggagtctcttgcatatatatttgccatagtgacagcaaggaagtcggggggggggcggtctacgtagtcaaaaagttatatatcagaattcaattgtaatgtgattgttggaaatcactttcccttagagaaaaagtaacaaaataatggttaggagtttgagccagtcagtggttaacttgatctatgcagagaaagacggttttgttgagtagaaataaatgggccaaagaagttatttgatctaagttatgcctaaaatactccagtctatgagatataaacttcatatagtctatgaagtataagaatgtctttagaaatttagaaatttccctcccggaagtggggaccagccctccttctgggtctcacccttgttggggcaggcacactggctcctgctccctgccacttggcaaggggctgtagccctttgcagaccatgcatgtttaatgagctcagttcagggctgggaagatggaggacacgatttgggggtataatagtgttttgaaagtgaggcaggcacctgccacagcgttgtgcagggaaaagggaagagtcaagttagtggaattaaagctggtaggcgtggctctttatccatgctgcgtggtaaccaattcgagcagaccccagaggtgaccaagtgctgtggagctgaaccccagaatgagtgatcttgacaaccactgtaaattcaccaaactccccagagggtacatctgtgcattccccagtgcctgctcggcacctgcctgttgaaagaatgcttcaacccctttggtccagtttccagttaattctctttctgaaagtaatgttgaggttgaggcaagagctgcagtgttcttagtcggccagaaacctccaggtttgacctcctataacattgcctgctgcctggatgactttggtgggtttttcctttttttcttttttctttttctttttctttttttttttttttttgagacagagtctcactctattgcccaggctggagtgtagttgcatgatctcaggatctcagctcactgcaacctccgcctcctggattcaagtgattctcctgcctcaccctcccaagtagctgggattacaggtgcccgccgccacacctggctaatttttgtatttttagtagagttggggttttgccatgttgaccaggctggtcttgaactcctgacctcaggtgatctgccccacttcgacctcccaaagtgctgggattacaggcatgagccaccgctcccagcctttggtaggtttcttgctttatttgttggtgatttgtctctgagcatggaggattctcacatggcaagtataggtgagatccagtatgtcggggctgggactgactgagtgaggatgtgagcggatgttgcctgtgttgacctggtcccccaccgcctgccttttccttgtcccagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaaggtgagcctttctggccgccacctccatcctgcagcaccccggcccctgctgtacgtgcccttagccaactgacatccattcggtcgaagtctttctggggctgagtggacatcgtgattaataaaataagcagaggtgttctaggatttcagtactggaaggccactagaagcatgagccattctttttacagccctggaaatgtggtttgtgaccatattgaggctcaccagggaaacctgcccaaacttgctggaaggacttgcagggcttctgcaggtgttggcaaaataggcagttgtagggaatttattgtccctttaagaacttattgaagcagggcgtggtggctcacacccgtaatcccagcattttgggaggctgaggtgggagaaattgaggccaggagttcaagacctgcctgggcaacatagtgagatccatctctaccaaaaataaataaataaataaggccaggtgcagtgactcacgcctgtaattccagcactttgggaggccaaagcaggcggatcacctgaggtcaggagtttgagaccagcctgggcaacatggtgaaaccctgtctgtactaaaaatacaatattagccgggcatggtggcacatgcctgtaatcccagctactcgggaggctgaggcaggagaaccacttgaatctgggaggcggaggttgcggtgagccgagatcgcgccactgcactctggtttgggtgacagagcaagactccgtctcaaaaaataaataaataaaaataataataaaccaatttttttaaaagaatatattttattgagaatttatcgtcctgggtctcctttccagtctgttgtgtctcctcgttctttaagacacttgggcctgacacttgcaaggaagccatgctcctttgtgttttcctttggctgcagaccacaggggtgaccctggactctaatactgagttctgaatgtgccgctgtgttaaagtgaacaatcagagagagaggatgcaggttctccttttccttctggccgaatcagtcaaaggagaatgcagcgtctttgctgtggttgctgtcagttctgctgaagtctttgatctattgtttaaatggggtttatggtgactgaagacagtggtcagttacaaaaccaagttcctcactcccatgtatctcctcatcaagggaacaaggctggaagctctgtttagattttccgtgatctggcatctgacaagagagatccaaggcagtcgagtaacatctcacaatcgctcctttgataggtgaggcggccttcgttatgatctaccgttaactcacgaggaaactccacagaggtgcctgcccaacgtgtggggctggggagggagaggagcgtgcagttgaaaacatgaacccatatgaccgggtgtggtggctcacgcctgtaatcccagccctttgggaagccgaggcgggcagatcacttgaggcctggagttagagaccagcctggccaacatggtgaaaccccatctctaccaaaaatacaaaaattagctgggcgtggtggtgggcacctgtaatcccagctacttgggatggtgaggcagtagaatcacttgaacccgggaggcaaaggttgcagtgagccgagactgcgccactccactccagcctgggtgacaagagcgaaactccatctcaaacaaagaaaagctgacccctgcacatgacccctccgagcacagccagtggttcccataaacccctaagtgaatttaggccagacacatgtgaacacatgttaggaattttcttaatttggttgggatgtgaggaatcctggcatgccccgggatcacctgtgcagcttttacggcatgcccctatgaggggactttgcagggaggtcagatggcctagacctcccctggagcagtgaccatacttggtgtgtgtgcttgtcccatcactgtctcatgcttaagaggtgaacttgattgcagcccattgtattccacattgtttttcccgagtgcctctgaaactctaggtgtgaggccaggcactcggccttagagacaccagctgattctgatgcctgaggcccaggcccagactcagatatataacccatttggggtgaggcctgagcattgggattttaaatgctcccactggtgattccaacgcgaaaccaaagttgagtccccattgtgctcatctacttgggtctggaagtccagcttgggtggaggtcctagggtacctgtgttgggtgacgccctatgcccagtgtctgccacggtgcctggcgcacaggggtggctgcgagtgaactcactggtgtgtttcccactgcaggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccggtgagcagcctgcacaggacccgagggtgagggaggaatgggtggggggactggacctcagcagtgatagctgagagactgaggcccactagggggttttgttagatgcaaatggtactttgtaaattgtgaggacttcggcaatttaaggacctagtgatctagcatttagaactattagggagtgggtttgctgttttcactgaaaaaccagattgttttgttattaaaaaaggaaagttggccaggcacggtggctcacaactgtaatcctagcattttgggaggctgaggcaggtggatcacctgaggtcaggagttcaagaccagcctggccaatatggtgaaaccccgtctctactaaaaatacaaaaattagccgggcgtggtggtacatgcctgtaatcccagctactcaggaggctgaggcaggagaatctcttgaacccgggaggtagagattgcagtgagctgagatggtgccactgcactccagcctgggtgacagagagagactgtcattcataaatacataaataaataaataaaataacttatttgtgaaccttcaactacaaggtaagtggtttattttctatctgtgctctaagattcttttagactataaaatcttgttaatcagattatcagaaatgaagaagaaataaacctttcagttcagagaacttccagaggcatctttaacacaaacataaaagaatataggtagaaattaggaaagaaaagaaaaactaaataagcctgatgagtcaattaaacttcagtgattaatatctaatgcattttatgaactaacattacttcctacaatagctgtatttaatgacttcacaattttctaagggatggtttgcaaactttgagtgagtttgtttagcttgaggcagaaatttaaaaataataataagaagaagtactgcattcattcattccaagaaaagtaacagacaaggctataagaaggttgtagtgacctagtctaagaagtaaaaaccaaggcccagaatgtggcaagacaagggttaaaaagtaaagaagggctggacggtggctcacccctgtaatcccagcactttgggaggctgaggcaggcagatcgtgaggtcaagagatcgagaccatcctggctaacacggtgaaaccccatctctactaaaaatacaaaaaataagccaggcatggtggcaggggcctgtaatcccagctactcgggaggctgaggcaggagaatggcatgaacccaggaggcagaggttgcagtgagccaagatcacaccactgcactccagcctgggcaaaagagtgagactccatctcaaaaaaaaaagaaagaaaagaagaacaagttttcctctgcctagcaagctcacttcaaagacagttataagctaacgctgttcgagaagttgaaaccaaaggaataagctccagacacccccctctccagatcaagggtgaaggaaaaaaaggacaaatgtctgtatttagccagttcttgttttttcttatcctgtatttatcttaatctttttttttttttttttttttttgagacagagtctcgctctgtcacccaagctggagtgcagtggtgcaatctcggctcactgcaacctccgcctcccgggttcaagtgattctcctgcctcagcctcctgagtagctgggattacaggcatgcaccaccatgcctggctaatttttttttctttctttctttttttttttttttttttgtatttttagtagagacagggtttcaccatgttggtcaggctggtctcgaactcctgaccccaaatgatcctcccgcctcagcctcctaaattgctgggattacaggcatgagccaccacgcctggctatctcaatcttatcttacagagaaaagcaacccattagctaagtaagcagaggtgtgtgaaatggtttcctgtctttataaggctcctggcctaaacctctaacctctggttttcctttaggggaaaagctggctgccctatcaaataggaaacattttattgttccacattgtaagaaagtaaaactgaaagaagtgtaaacaaagaaccttcttaaaagtttggctactattcatggcagctacattttttagtatttctttttctttctgttttaagaggaaagctctatctccacagttccttgggcattattattattattattattattattattattattattgaagaagagtctcactctgttgcccaggctggagtacagtggtgtgatcccaagtcactgcagtctttgcctcccaggttcaagcaattctcctgcctcagcctcccaagtagctgggattacaggcgctggccaccacagccaactaattttttgtatttttagtggagacggggtttcaccatgttagccaggttaggtctctaactcctgacctcaagtgatccatgcgcctctacctcccaaagcgctgggattacaggtgtgagccaccatgcccagccttagttttggtatttttagtagagatgggtgtttcgccatgttggctagactggtcttgaactcctgagctcaagtgttccacccgcctcaaccttccaaaatgctgggattacaggcatgagctactacgcctggccttccttgggctttaaaagttccccagcactaccttgctgcttcctctaatctgtgtttcctgctgaccacagaaatggtctgctacctccgaataggagagaacatctttgctctgccattttctttctctgaaaaaaatgataagtgtcctgcttaccccaccctatttctgtaatcctgtagaaatctatttttaaaatactgctatgcacttcaagcagctcatcaatttctgatgtctgattcttcttcatttcttgatcttgcttaatgtccatggcatagagtttttttaaagctcttttgtgtgcctttatcttgtttgatcatcctaaaaaccttatgagaatgacagatttcttcttttcttttttttttttttttgagatggagtctcactctgtggcccaggctggagtgcagtggcgcaatcttggttcattgcaacctctgccttccaggttcaagccattcgcctgcctcagactcctgagtagctggcattacaggcacgcgccgccacgcccagctaatttttgtatttttagtagagatggggtttcgccatgttggccagactggtcttgaactcctggccccaagtgatccgcccacctcagcctcccaaagtgctagaattacaggtatgagctaccatgcccggctcatggcatagatttattgaacactgcttatttaaaatgtttggcaatatcaaagacttttgactcactaatttttttttccttttcttcttttttttttttttttaaataggcagtggtcagtggcctatttgacttctcctaaaaaagacttcaatattttaaagtgtcatacgttttctgattatagaagtactaacatggttagttttaaaatggaaataatgaggacataaaaacctaagtggaagtcctttgtaatgctagttgatagaactagggattgttaatggcttgcaggtagtctcccagactttcctagtggctgtgtattatacatactctctcctaactgggctcattctacataatactcttctgctgcttgattttttttttcctttctttttagagacaggggtctcactctgttgcccaagctggagtgcagtgacaccatcatagctcactgcagtctcgaactcctgggctcaagagaccctcctgcctcagcctcccgagtagctaggactacaagtgtgtgtcaccatacctagatagcttttaaattttttctagagatggagtttttccatgttgcccaggctggtttggaactcttgggatcaagcaatcctcctaccttggccttggcctcccaaacaatcctcctaccttggtctcccacagtattgggattacaggcataattcactgtacctggcctgatttttcctttcctttttttttttttttttttttttttgagacagagtctcactctgttgcctagtctggagtgtagtggcatgatttcagctcactgcaacttccatctttcaggttcaagtgattctcctgtctcagtctcccacgctgggactatgggcacgcaccaccacgtccagctaatttttgtatttttagtagatggagtttctccatgttggccaggctggtctcaaactcctgacctcaggtgatctgtcctcctaggcctcccaaagtgctgggattacaggcatgagccaccatgccaccacacccagcctccagtttgtctttatacacatgtgacatttcggtgaatatccacatccttatggctttgaaagtcttctgctgacatttctgcaggatacatttctgtttttttgttttttaagacggagtttcgctcttgttgcccaggctggagttcagtggcacaatttcagctcactgcaacctctgcctcctgggttcaaatgattctcctgcctcagcctcccgagtagctggaattacaagcacctgccaccacgcccagctaactttttgtatttttagtagagacagggtttcaccattttggcgaggctgatctcgaactcctgacctccggtgatctacctgccttggcctcccaattgctgggattacaggtgtgagccactgcacccggccaggagacatttcttgaaagagaattcctaggaaaaaataatacgtatttttaaaaattgctcccctccaaaaaattaaaatacttaagtttactataacaatgtaactaaatgatcccatccttgaacattctgtaaaacctatccaccttcctttgtctacttttgtctgtaatgtaaaccggactctggtggtggtgtttcatgtgagaattttaggaatattgatctttctgtctggctttaagacaaagaccgccctacagctaatgtatcatagctgacccttctgtctaaagtcatttgtcatcttgtaattttcagatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcaggtgcgttacgctccttgtgacatctttattgctttagtgatggtttttataacgaatgactgttttgccacggatgtggatgtcggttggaggataatttcatcccaatgagaagcctgtttagcattatcaagaggggtaacaagcaactaaatgttctgatccattatgttatgttatgttatgttatgttatgttatgttatgttatgttatgttatttttgagacagagtctctgtcacccaggctggagtgcagtggcatgacctcagctcactgcaacctctgcctcccaggttcaaacaattctcctgtctcagcctcccgagtagctgggattacaggtgcctaccgccacatctggctaattttttgtattttagtagacacggggtttcaccgtgttgcccatgctggtcttgaactcctgagctcaggcaatccccctgcctcggcctcccaaagtgctggggtgctagagggagccactgcgcccagccctgatcctttatttcaaatccgcacaggtacccagtctagctcagtgttgcagggcatgtcagctactctctactatttttgcaaaacagaaataaaaatgtgaatcatcttcacagaaattctaaaacattgaaaccatttttccaaagtgactatatgaatgtaaaatcacacaaaggatggttaacattattataatgatattctatgacgagagctccagtttatttgggatggtgatctctccctagttcctgtgtttatatataggatt

SEQ ID NO: 85 - DNA, 13651 bp, Homo sapiens
gggcatggataaaataccctaaagaaaatatcaatgagataaggggacaccaaagtctatggagcagaagatgggcatatgaaaaaggttttaaaaagaatcttcacttattgattgtatagctatttattgagttccaactatgggttgggctctgtttctatttctggggtgggaaagctgtcaaaaaaaaccctgcatcatgaagcttctattctagtaagacactggggagaccaacaatatacaagataaataataaaacacgtagaatgttagctattaagtgttagtataagaatatttaaagcaaagaggagaagtggctatgtagtgaagggaggaggggtgaaatcatagtgtccctggccagagaaggatgcactaagaaggtgtgaatgaagggtcgaaggaagtcagggagggagccatgcaaataccttcgggaacagaaggaacagaatgtgcacagacacaaagcaggggtgtgtcgcgtgttcagggcatagtgcatagggcagttggcttgaacagaaggaatggggaagagaagtaagagatgagtcagtatgacagggccactcacagcctcgcacgtcatgaggactttggtctggaaggagtgagctggaggccaggggggagttttgctcagaggaatgacatgatctgattgtaacaggatccctgtggctgacttaactgacaaaactgatattaattttactgatgttgacagaaggctatagcaatgcagaggggagagggcaggggagctagatctgatgcaggaggatcattaaaaggctattgtggggagctgggagaagctgataggggcttggagcagggtgggttagtataggggggagaatgtgacctgattctcaagccaaccaacataatctgctaggtagtttcatgtggggtgtaagaagtagagaggaatgaacgttcgctccaaacttaagcaattggaagaattcactgaaattggagacagatgtgaagaacaggtttggtggaaacatcagaagtctgattcaaacatggtgagcttcagatgcccactgaatgtccgagagcagcagatgtcaaggagaagctcaggtgcaccagtctggaattcaaggggaaggccagggccagcgagtatatttgccagtggtcaggatatagatgatatctaaagccaggaaacagcatgaggtcccgtaggggtgagtgaggacagaaaagagaggggctcagaggactgagccctgatgactccaacgatgaccaaggattaccttgactttcaaggtcagagagatgaggaggagcctcagctgtgcttgggggtggggtcagctgtgggtacgggctgcccaatctgaggaaggtggagagcatttcagggaaaaaagagagaggctccagctggatctgaagctgatggggaggtagagtatgacgagggccaaaatcctcctttagatttggtgactgggatgccagtgattatcttagtcagaataccttcagggtgtggcagaatcaaagctaggctgtggcttctgagatttcaggggcttttggaggaggaggaaatggaggtggtgaacttggacaaacatttaagaatgtttgctacaaaaattacaatgatgatgatggtcgctcactaatatccatcatctattctaaacactttacatgcattgaatcaatggaaagcagcacaaagagataaggtggtttcctgacactaaaccgggtcccagaaaggtgtgtgcctttggctgtggtgtgtgtgcaaatacctgaaaccacagagcaggtggacaggctgaagggaaggaggcagtgacagaagaagcaacagacaccgggaggaggggatgactgggagccccagagcctggatctattggatggaattcagagccagacagagggactcacctgagtgaagaaggagatgcacgctctgttcccaaaggaagaagggaagagtggcgagagaaatttcattaacttactaagaaggaggccaggaggccaggtcatttggaggagagagatgaacagggtatgggagatactgagcagccgcagatggcctcattgggaatggagaccaggtgggctgtgtctaccagaagtgccgagcggcccgagagcagggggcccaggaatggatgagcagagtatcggtgccgagaagtcaccagaggaaaaagaaactgaagggaggaacatgaaagaggatggagtgacggcccacaggatcgggcttggcaaggacagagttaaccctggtgggaaacatggagttggggagggcaaggaagggaggaaggatctgagggagctcatgggggagtgcagtgtgtccagggacaagaaggaggcatgggaagcccagggtgcattcatttcaggggtatttgctgagaggccgctgtgcaccgtgcactccctcggagccctgggcacattaggaggtggcatttagagtggcctagggggcaagagccggagtcacagagtagatgagactgcccaggagaccatgagttaagagacaggagactcaagggtagaacttcaggggaaatgtctcttccatgaaaggggtgaacaggagaagttgtgccagagccctagggaaggaggaaagctcccgacccccaacctctaccctacctgccatctgcccacttccatgagctccatgagtgagccctgaaacacaggggaggagagaggttacagggtaaggggactgcatctgaccacctgactgaggaacagtcttcctctacaggaaagtcattctccccttctgaaggtgcggcttagagacgggaggacacttaggaagcagtgagaaattggatatgcagccaccaagccagggcagctgagtccacctggtggccggtgggtgacatgaaggcagtactatcatctcaagtgatttcaagataggttgcagcaaagttatcaaagatggtcagtattaatgacggccatggaagctccgatttgtgtagactggatcttttactaagtcctttcaacatccttcacctcatttgattttcaccatagccatgtgagacttgacctctcaaagatgggaaagttgaggccaaaagaagatttaacgaactcgcccaaagacacacagctggaatgaaagttatttgaaagtgaccctttgcaatgggagcctgaagattgtttaatttattgtgcacggtcctctttttttatgctatgtgaaatgtcaagaataatttccttgtaatcaacaatgttcatttctttgtttctttcccttttactgccttttcagaaactctgctgatgtcttttggaagcgtctattccaatgagtcttttccagctttccattattggtgaggtgtgagggaactagtcactccccaaagattaccagaaaagttcattttctagttgagttgggaggtgcacctcaaccaggaacatggagacttcctgctggtttcacatggaggcctcccgccttctcgtttatgccagtggggcagttattgagttgggtaaagatgctcttactggtcatacagggtatgttgaagaaatgaaaatacaacttagataagcattcagttcatttcaaccaatattttctaggtgcctagaatgggagctgtttggacaaaatggtgcatggggatttaacattcccaaggtcaaacaaggcccgggtctctgggtagcagtccagggacaaccagcaccaccacagatggcttcccaggcagaggggagcagccttgcacagatacaatagttatgtgcttttagggacacacactccttaaaaactgaagtatggaatctccaggaaaatgtacatgcatgaaaacttctacatataatttgtggagttttatgacagtcagtattccctgtacctcagactaagaagcccttaagaacctggctcttttttttttttttttgagatggagtctcactctgttgcccaggatggagtgcagtcacatgatcttggctcactgcaactcctgcctcctgggttcaagtgattttcctgccttagcctcttgagtagctgggattataggtgtgcaccaccacatctggctaatttgtgtatttttggtagagatggggtttcactgtgttggccaggctggtcttgaactcctggcctcaagtgatctgcccacttctgcatcccaaactgctgggattataggcgtgagccgccgtgcctggccgaaaccctgatcttctgaacagactcaaggacaaagcagatacgtggcaaatttcagctgtatatcacagagttctacgcccgtttctgcagcctttgaaggaaggccatggcgacgccttgtaacatcggtctcacccccacttcaccccaccccactcctttccctgaagtaaaccctcctccctgtccaagccaagctccagcgctcacccatcctctgggccctcatggcattttgttgacactccggttaaagccttgcttccttgtctacctgggtctctcccctaggaaaatgtgagtccctcgacagcataggaacaacaccttgtcccttgcacttcccactgcctggcagcccagagatgcttagtaaataccacttgtgccaatggatgcttaaatggctcaggcaccaattttgattgtttcgtaattctccaatgtgattaaaagtcatttgctgcttcaaaactcagagcaaaagttattttacaaaggcctgttaaaatgacacagtggtgcatggtctaatgagtccttgcaccccaatgtgaagcaccccaatgctctgaaagcttgctaaagctcttcttctgaaagccaactgtgtccgcttctcatggtaaagttttacagtagactttggcataaggtaattccatcctacgggacccgagccaagatgtaagcccctggtttaaggttatatctcctttgtgcacttaaaaatgtgttaagagaatagatcacatgcttagtgctcttaacacagtaaaaaatggggagacacaaagaaatttgtggaggcaataggtacatttattatcttgattgtggtgatggtctcaatggatatgaacatatcaaactcctcgaactgtgtacattaaataagtgcaggtttgtatattaattttaaaaacagctcaataaagctgttttttaaacaggtatttcttatataggcagggcctggggttaatggaggcaggggcgctgggatgtgctgggagggaggagggaacaggaaaggctgggagaacaggaggccctgagaggacctaggggatttgagggtgagggagggagctggggggcgcggggtgcatggtgagcccagagtccatagtttaaggtgcagaatttagactagccattatcaggtaaaagtatgtcacaggtggtcaaaaaggtaataacatctaagaagtagacatgctattcaataaccaagttttctgaagacttcatcaggtatcttgaaacccaggaaaaggaggcatgccagccttcagcatggaggaaaacaaagtggcatttgggatgtgctgaaaaggcgtggggacactcaggtccccatctgggccagtccagggagggccctttggggggctgtcctggtcaaaacaatacagcaatcccaaactcaagccggtgcaggagggcacgaggctcagggtccggagtggctgacccctcagtggagcaggtagtgccaggtacccagccaggaggttgttgccgcagggctccccaggggcagtcagacacccaagaagcagggctgggctggctcagtgctttcttcaaggtccgcttcgaggtgatggaggcctggcagcagcccatggccccaagcggggctcccagggaagtggctgcaggagctgggcagggtcccaggcccgaagagaaggccagccctcaccctgggcccacagagaaggccagccctcaccctaggccacagagaaggccagcccacaccctgggcccacagagaaggccagccctcaccctaggccacagagaaggccagcccacaccctgggcccacagagaaggccagccctcaccctaggccacagagaaggccagcccacaccctgggcccacagagaaggccagccctcaccctaggccacagagaaggccagcccacaccctgggcccacagagaaggccagccctcaccctaggccacagagaaggccagcccacaccctgggcccacagagaaggccagccctcaccctaggccacagagaaggccagcccacaccctgggcccacagagaaggccagcccacaccctgggcccacagagaaggccagccctcaccctaggccacagagaaggccagcccacaccctgggcacacagagaaggccagctcctcaccctgggcccacagagaaggccagctcctcatcctaggcccacagagaaggctggctcctcaccctaggccacagagaaggccagctcctcaccctaggcccacagagaaggccagccctcaccctaggccacagagaaggccagccctcaccctgggcccacagagaaggctggctcctcaccctaggccacagagaaggccggctcctcaccctaggcccacagagatggctgcagtattgcagggagacccaagcaaagccatccctgtggcagagatgctgacattaacaacaaaggcaggaactgagacccaggtggcactcactcatgtggcactcattcctgtggcactcactcccatgtcactcactcatgtggcattcactcatgtggcactcttgtgagccaggtagtcttctccatgctgggcatatgatgacacattgaactcctaacaatcctgtgagggaagtgcgaatagcatcaaacccctcgcacagatgaggagactgtagcagtgagagatgaagtaacttgccaggctagcgttcgtggagttggaatttaaactcgagcagcgtggctcctgggctcattctcttaacccctatgctgtattttctcatggtatggggaaagaggaaggagggagggagtcaaaagccagaggctgagcctgggtttaattcgctggcagggccccctcacacacacaccgccagcaggggaggtggctcttgttccatgtcctggccccagggcagcagtcccgtggatggattctgggctgggaaaaggagatgcaggagttgctggaggtatgtctatgactctgtaaagggatggtctgaattccctcccagacagagtgaaagtctcgctgtgtgagtgccatggacacagcatgtgcacccctccagcccaagtggtgttattgaaacaaaggtcagatcgtttcctatttaaaagcttctcctggctccccatgtcactcagaaagcttgttaccatggcccagagacccctctgaccccacgttctaactcacctccctccactcccctcactctgctccatcctgtgggcccccgagctcccagctcagggcctttgcacatggcgcagccccttcctgaaactcccctcccttgcagagctgcatggcttactcctttactcaacacaggtctctcctcaaatgccaccttctcaggaggtgcctaggaccagcctgtgccaagtcaccttctccttgctctgcttcctttctccatgcaccaatgccatgtggagtgcacacactacatacaacaccttgaggggtccacacacaacactgtgtcagttatacacacaacaccaggtggagtctacacacaacactatatggggtatacacacaacaccatgtggggtctacacacaacaccaggtggagtctacacacaacaccatgtggagtctacacacaacaccatgtggagtctacacacaacactatatggggtatacacacaacactgtgtggggtctacacagaacaccatatatagtctacacacaataccatgtggagtccacacacaacactatatggggtatacacacaacaccatgtggggtctacacacaccaccatgtggggtctacacatgatgccatgtgaagtctacacacagcatgatgtggaatctacactaacttgtttatttgcttgctgtatatccgcatcccccccacacatcactagaacttaggtggcacgagggcaggaacttggatgtgttcactgctgtaaccccaaatgactgctgaatgaatggaatgaatgaacacaaagcgtcctccccagctgcacatctaaagcaggaggagcccctctcagttggcccctggggtgcctgtattgagtttctctctgtggatgccaaccatacatggctgatgacgctcctgacaaagcccagtggaggttttggttgcctatttcccctcttttttaagctctgtaccaaaattgattcagatcatcagatacaggcaccctgttcctactttgttaacttttctccaaaacacttcatagaaccctgagtcaacatcctagctacggctcctatggaagttcaaagcaagaaacaaaattatgtccacttttagaataattatgtgaactttttgttcttagtaaactgctataagcttaaaatgcatcagctttcccaagcttcctatctggcctgcttactgtgtaattgccatttttaatggtaacatattttaactgtatcacatcactctagtagaagagatttgcagcaatatttacttctttggtcatattgttatcatgatgaataaacgggtatggtaacatcagaagattaaattctctctcttaatggaaaattaactctgaaaccagacattctagaatttctgtttcctggagcaatggttcctgatttgtgggcagcagagccctgggggacactccaagccccatccttcttcaaggagtctcgcagtcattgtaggcgccaagtgcctcctgcatactaactaacagtcttgtgcaccaaggcttgactgtcatgtaaatgtgtcctcacaggactttgagatcaacaagttatgacctcacatatgcttttgacagtaggtatttttcaatcaaactgcacctattatcatgcagaaggctctcaaatagctaacctcaaagggatctgtgtgctctataaaatttagaacagcttctccataatttggagtctttaggagaatacaatatattctaatggagatatttatcatcagaagtttacaaagacatatgaaacaaaagctcagttgcaagacattaagagacagtgcaaatagcaagcaattaactaggaattttctttggtcaagtttcttccctgatatgaaactcacttcatgtttagcttcccctgttctaaaaatccagcaacactacaataagttcactctctgcattcacttcatactatgttcctaatgctgcactggcaactttgctgctcacttttaattaaagcacaagggttgtgggaaaaacgacttctgcaggcattgtaatcactctgagggactgctttatctgtcctctaactctctatgttggcctctgaataaagctgccctcaaatgggtggacagtcaagtactcttcatgggggtcttagttctagaaggcacagagatgacgtatgtgggaattccaaacacaggcaggaagagggaaaacacatggaagtgattttagtgcctaattttggctatctctatacaagtatgacaagatcgaacacatctgaaagaaggaatcggcactgacattttatatcaactcatttaagagcattgctaaattcatcgcaacctttgatattcaagacccataaatatcaagacgtgtgcgtgtgtctatgtgcatgtgtgtgtgttacagatacagacctcaccatttcaccatttgtgcattgctgcaactctgtcgagcttggtttcagccttatataaccctggtgggaaaactcaactagagtgaggcagtggcttctccaccagggtgtgacagtggagaaccaaacagataggtagaagtatggacccagcccctccccttttctcaatacaggccattttcatcagtctatctaatttgtttatgcctttatccatgtatttaggtgtgtacaaaagttgggctgctaaagaagtttgaaatccactgccctcatctacattttcactgatgcataaataaattgctttatttgagtcaaaatgcatttattttgtgagggattaaaaggccaactatattgcaattaattctagagcctatttttgttttaagaatgaactaatggggacctatacatgttgcagccatccaggttttttttttttttttttttttaagcaattaaagcagcaacacaaatcccttggtgtcctggagaagatggggtgggtcagaggagaagcagcacaggtggtagaatccagggacctggccccacccaagtcctcaccctagtacactaccccagtggccctgagcaagcatttgatcactgccattatgtctgctgtgctgggggtggaggaaatgggaatgatatcgtcagtactcccaatgctaaaggatggttgagaggatcagcctgatctacaagcttgttttcaattaatattttcaaatataagtttgggaggggaaaaacattcaagccaaagcataggatatacctgtttaatgagaaatacataatgagaacattaggatgatcacaagaggggcttcatatggggtctaaaacagaattaaattctagcaagctaaagattgtttccggacgggcatggtggctcacgcctgtaatcccaatactttgggaggctaagacaggtggatcacttgaggctaggagtttgagaccagcctgggacacctggtgaaaccccaactctactaaaaatacaaaaattagctgggcgtggtggcacatgtctgtaatcccagccactcaggaggctgaggcacgggaatcacttgtacccgggaagcggaggctgcagtgagccgagatggcgccactacactccagcctggacgacagagcaagaccctgtcttgaaaaaaaaccctgaaatataaaaagtgaaagattgttttcctaaggaaatcaaaaagaaacagtcatggggttatgttgctaggaaaggaggaaagtgaaggcaatttgtcaccctgagaaagaatggacttctgcttgacatctctagctctgtttttcctttgttcttttaaataaataaacaaaacataaagagaggaaagcccagaattccaaaataatttagcataagcaaagggagacagactccagagagacccacagtcggcttcccagccggccctccgagcttgttctcaacttttcctgatacctccgccctgccctgctgcccccacagctctttctgcaaagtgtcagggactccaccctcgggagggtctcactttccacatgagcggctcctcttcgcatgtttcctaattggacctatttaaatcaggaatccactgccttgtgcaattaggcatctaataattgttcaaagttgatggtaatttttataagtttgccaaggtcatttaagcctaatgaacttgagttcaatccaaactctaagtaatggctcatttacagtttggatgtgttcagtatacagtaagttggttttttctctaactgcactggtttgctaagatatttctgacaataattttttagtaatgccctttgtggagtaatgagattctgagaccatggcctttaagatacttgggtaaggtttacttatgtaactgtattgtatcctccgtacaagcctttttatcccttattttttttctcattgttttttctcattgtttccttagaatattcattttttcttcattattttttctcattgtttccttagaatattcatttttttcttttttcaattttatttaacatcattatgtcttttttcctccaccctatggaaggtactttttacacaaaagcttctgtcactaactatgattggaaatgtgacatccagtgtgaacatttatcttaacagaatcattaatttacaacaaaatgctaaataccagtcccctccaggaaacagtgaagcagactttgcattccttagcttttttcttataaaagatattttagatccattttactgcatgaatcatttctcttccaaatccaatatgttaaacgatttcacagtatagcacttatcaaaacctacatcctggccaagtgcagtggctcacatctgtagtcccagcactttgggaagccgaggtgggcggatcacctgaggtaaggggttcgagaccagcctgaccaacatggtgaaaccccatctctactaaaaatacaaaaattagccggacgtggtggtgcatgcctgtaatcccagctacttgggaggctaaggcaggagaattgcttgaacccaggaggcggaggttgcagtgagccgagaccatgccactgcattccggcctgggtgacagggtaagactctgtctcaaaaacaaaaaacaaaacaaaacaaaaccctacatcctgtgccaggtcctagaatgattccacaatagtggtggtgtcccctgctgggtttgaccctgttctttatttcagctagtgtccgcagcaatgactctcagcagatgcttgtcacagcggagggcatgtttcatgctagcagctgcactgcatttgatgtgcaggacagccctaggagggttgctattcccattctacagataagggaactgacggtccagagtcacatagtgagagcagtgaagccaggatttagacttctgtaggtctgaattcgaacccagtcactgcactgtacatgtacgagtttcctctttcaaccacatggaactgactttgtagactctcgggaagcaaataagtctgacatgacctcctcactttgtccattagtgctagcaaaggtttcctgaagttgcaaagctgattcttgcagcctcatgggcacccatttgagggggttcacctaggcccagaaccccctcctcctggtgggagccccatggacctcccctccgcaaggccttttagaaatctgagagcagagttctaagcaagaattcagagaatcgtctcccaaacccagaaaggccgacttatccaccccagggcatctgacctaaattccaacctttcgctcaattctgagctctagagactaccttgattttaattaatggaaaagacaaaacagaacaaaacagcagacctgcaagaagtaagaactcccttcatggaatgctttgtcgccttggggatgctggatgctatttatacccccatttttaatcatatctttaaaaattactgatgaagtttaaagcattcacctgatggcatgtcagcacctccaaatgcataatctcgcctgtgtcaaagaactggggagtccaccccatcaacccctaggatgctggctgactcagcgtcaagcagtgccaagctcccaaagccacgatgcttaaacaggtgaaaaattatgcatgtcaggttccaaaa
